United States Patent 12,642,819 (COMPOSITIONS AND METHODS FOR TREATING INFLAMMATORY BOWEL DISEASE) - sequence listing, part 5

SEQ ID NO: 3 - DNA, 3640133 bp, Anaerotruncus colihominis (residues 1,820,068-3,640,133 of 3,640,133)
  modified_base (130425)..(130431): a, c, t, g, unknown or other
  modified_base (162254)..(162351): a, c, t, g, unknown or other
  modified_base (1121927)..(1122016): a, c, t, g, unknown or other
  modified_base (1308446)..(1308542): a, c, t, g, unknown or other
  modified_base (1651266)..(1651359): a, c, t, g, unknown or other
  modified_base (2343578)..(2343585): a, c, t, g, unknown or other
  modified_base (2622903)..(2622909): a, c, t, g, unknown or other
  modified_base (3626778)..(3626980): a, c, t, g, unknown or other
  modified_base (3630377)..(3630482): a, c, t, g, unknown or other
cgtgcatggggcgtgccgaaaatccgttctgttatcgccggcgggcaaacgcgtcaacagtcggttcaacttggcgtcgaagcggtcgggccgcaggcaaggtatgtggcggttcacgacggcgcacgtccgtttgtatgtgggcaggtgatcgctgacgctgtgttcgacgccatccgatatggcgcagcggcgcctgctgttccggtcagcgatacgatcaaggtggcggatgcaaacggtatgattgaatcgaccccggatcgcagccgtcttttcgcggttcaaacgcctcaggtattcgaactggaacgttaccgcacggcggcgcaggccgcattgcaaagcggacacgattatacagacgattgccagatgcttgaagcggccggatttccagtacacttgtcacgtggggacagcgataacattaaaatcacgacgccggtggatcttttggctgcgcaggcgattgcaaagctgcgggaggagatggaggcatgaagctgcgcattggacatggttatgatgcgcacaggtttgcagataaccgcagactgatcattggtgggattgaaattccgcatacacgcgggttagatggtcattcagacgcggacgtactgacgcatgccgtgatggacgcattgcttggtgcgctggcgctcggtgatattggaagcttatttccggacagtgatcccgcgtatgcaggtgctgattcggttgccctgcttgtgcgtgtggcagatttaataagtgcgcaaggatggcgcgttggcaatattgacgcgacagttattgcacaggcgccaaaaatcaagccttacatagaacagatgcgtgcacgtatcgccaaagcctgtggagcgcggccggaggacgtcagcgtgaaggcgacgactgaggagcatatgggctttacaggtcgtgaggaggggatccgtgcgcacgctgtctgcctgctggaacggagcggatgaccaccttgtgcgtgcctgcataagatgatacagcggtatgtctgccatgccgctgtattttgttatgttgggagagcttttaatggcaatagaaaattccattttggttgtacgctcgatcacctatgcaatgaagggccagaagcttttggaaagcaacggaatttcggcatatgtggagcgcaatccgttcccaaacagccgtgaaggctgcggatatggcctgcgagtgcagggggatgtatcgcgtgcggtttccatcctggaggcggcaggggtgaaaatctccgaaataaaaagggggaagccccaatgatttattttgataatgccgctacgacctttccaaaaccgcttgtcgtaaagaatgctgttgatactgcattgacacgttatggtgcgaatccgggacgcggaggacatgacctttcggttgaaacggcaaagcaggtatttgaagtgcgctccaagatcgcaggttttttcggcgcgaaggacgttgaggacgtggtgttcacacagaattgtacctatgcgctcaatacagtgatcaaagggcttctgcgctttggcgaccatgtaattatttccgatcttgagcataattccgtgctgcgccctgtgcatacgcttgcaacacgcggtataatcacttatagttcggcgtgcgtttcttttgacagcgatcagaccgtagcgtcctttcgctctctgatccgccccaacacacgcgcgatcattgtaacgcatgcttcgaatgtgttcggaacaattttgcccatcacacagcttgcgcagttggctcgtcaatatgggttgtatctggttgttgacgcagcccagacagcaggaacagaaccgattgatatgcagaagatggggattgattttctctgtgcagcgggtcataaggggctgtatggaccgtctggaaccggatttttaataacgtcctatggaaaacggcttctgccgctcgccgagggaggaaccggcagcgcatcctttgattatgaacagccggattttatgccggatcgcttcgaatcaggcacgctgaacacggtcggaatcctggggcttggcgctggcatcgattttgtttcatcatgcgggatggagcggattgctcgcggcgagctttacatcacacgctgtatctatgatgaattaaagggaattaaaggtgtaaagctttacacgcctgcgccgcagtatggaaccagttcggctgtgttaagctttaatatcgatggtttgtcgtcagaggagacaaccgccaagctcaattcagccggctttgcgctgcgcggcggactgcactgtgcgccagatgcgcataaaaaatatggaacaattgaaggcggaacagcgcgcttgagtatcggcgcgtttaacacggtggaacagggcgcggccttttccgaagctgttcgccggattgcggcggctcaatagagaaaatatggccgccaaaaaaagattgatttactgcggatatgtgataaaataaacgcagggcgtttattttatcctttatggccggggcgatacgcgggcgcggcccgctgccgccccgacggccaattttatcatgccgcggcgcggacatgataaaataaacgcagggcatctattttatcctttatggccggggcgatacgcgggcgcggcccgctgccgccccgacggccagttttattatgtccgcagtacggcatgataaaatatataaggaaacatgcggccgcatgtttggaacagcagaaaggaaatgaacgtatggccgagctttggtacaatatcgcggagacgttcagcacgatcaactggcgtgatgtgttggacatcctgatcatgacatttttgatctatcagggcatcaagcttgtccgtgagacgcgcgctgcccagcttgtcaaagggatcgcgctgctgcttgttctgtatttgctgtcggaagtactagagatgcgtgcgatgcagttcattacgcagaatatcttgcagatcggtgtgcttgcccttgtcatcgtgtttcagccggagctgcgccgcgcgcttgagcaggttggccgttcacgcattggaaaattacaggttttttcatccagcgtcaacgaacaggaggagcgcgcaaaatggacaaaatttatagacgcgcttgttggtgaggcggcttcgctatcgcgccagaagattggtgcgcttgtagtcattgagcagaaaacgaagctcggcgatattattaaaacgggaacgatcatcgattccgatccgtccgcggagctgattggaaatatcttttttccaaattcgccgctgcacgacggcgccatgatcgttcgcgatggccggctgcatgcagccggatgttttttaccgctttccgataatcaggagatcagccgggagcttggtacgcgtcatcgtgcggcgctcggcatgagtgaaatgagcgatgcgattgtcgtcgtcgtttcagaagaaacaggctttattacgatttgccgcaacggccggcttgatcgcggcctgtctttggagcgtctgcgggaatatttgacggcggaattgacgccggaaaagactccggatcagtccgaacgattgttggatcgcctcatccccaaaaaggcgagcagcgcacaggaggatgagaagcatgaagattaattttagccgtttgcttgacaataaaaatctgatgaagctgttgtcgcttgtgcttgcagtggcgatttggcttgtaatcgttatttatgtatcgccgatttcacgcaaaactgtacacgatgtgccggtttccgtttctcaggacgacagtgatgtgctcaattcgatggggttgtttgttgttgacaacgagactgcgactgttgatgtcaaaatccgggctgaacgccttgtactcagttccgtagctgcgtccgatatcgatatcgtcgcaaatctttccggcatcacagcgccagggacgtatgatgtggcgcttgttggcggcgtgacgagcaattacaataggggcgaccgctatggaaagggattcgagcttgacggaagcgatgcgatcagccctggaacagtacgtatccgtgtcgaccgggaggcgcgcgaaacgttcccgatcgttactgatatcgatggcctgtcctccccggaggaatattaccgtgatgaaccgctcgtcagccccaaggaggttacaatcagcggtccggaagccgatatcaaccgcattgaccgatgcgtagtttccgcttcattttcggagccgctgacatccagcaagacggttacaagtgagattatgctgtatgacgcagagggtaatgagatttcaaaggagcatctgacccttggcgtcgagacggcggacattacggtgccggtctataaaaagaaggagcttccgctcaactatgagtacattaacacgccgcgcgatttcccaatcgaccggcttgaggagcggtattctgtcgcaagcgtgctggtggccggcccagaaacgctgatagattcctacgatgtgctggaccttggttttatcaacctcagcgagatcacgcccgacaatcatctgttcccattcccgcttgacggaaacgacggaattctcccgcgcggtttccgcaatctttcgggagtcgatacagtatgggttgagattttgacagacgggatgctggaagctaattttacaatcccggctgaaaatatcaaatcgacgaatgtaccgatcaattataaagtaacaatccagtcaacaagcattcccaatgtgcatatggtcggcgacccggatgatatggctgcgttgacaaacacagacttggtggcggagattgatatgacctcaaaggaggtttcgcccggcacgtatctggagatgccggttcgtatctcggcgcccggcaaaggacttgtctgggcaaccggcgaatataaggcgattgtgactgtgacggaaaaataaaacgcggggcgcccggctttccgggcgcccttgtgcttcacaaggaggaaaatatggcgatcatcgtcaattcgatcatcacctctctgacagaggatcgacaggaagccatccgaaaggcaatcagcatactggaagtccctgagccgcttgtccagagcgcgtatattgcaaagacatcgcttgacgcgcgccggcgcagcgatattcggtttgtgcattccgtctcggtgacgctcgcggatggggaagcgcgtgtgacggagcgggcgcagactgcgggaaaaaaggttgttttgcgcgtggaggatcctctgaaagcggcgttcggaccgggaaaactcagtcaccggccagtgatcgcaggctttgggccggcgggtatgttcgccggacttctgcttgcgaaaaacggatacgcgccgctgattttggaacgcggcggagatatggacagccgtgttgccagtgtggaacggttttggagcggcggttcgcttgatcctgacacaaacgtacagtttggcgagggcggcgccggcaccttttcagacggcaagctgacgacccggatcggcgatccgaagtgcgcgtgggtgctccgggaatttgtccgcttcggcgctccggaggagatcctccacagggccaagccgcacatcgggacggaccgcctgcgcagcgtcgtaaaaagactgcgcgccgagatcgaatcactcggcggagaagtccgtttttacatgccggcatccgatttgatactcgaaaacggccgcctgtgcgccgtccggacaacgcagggggatgttccagccgacgttttgatcctggcggcgggacacagcgcgcgcgatacatttgaaatgcttttgcggcgcggattggtattacagcccaaaccattttctgtcggcgtgcgcgtcgaacatctgcaaagtgaaattgatcgcggcctgtacggcaaatatgcaggccacccggcattgccggtcggcgagtaccagttgtcataccgcacgggagagggacgcggcgtatatacgttttgtatgtgtcccggcggagtggttgtaccggccgcttcacaggaagggatggttgttacaaacgggatgagtgattttgcgcgcgatggaacaaatgcgaacgctgcattggccgtctccgtaacgccggatgattttggtacggctccactcgatggtatgcgctttcagcaggagcttgagcggcgcgcctttacggcgggcggccgtggatacggcgcgccggcgcaggatgcaaagagctttctggaaggaaagacgggacttcacatcggccgtgtggaaccgacgtatgcgcgcggcgtccgtggctgtgatttcggcgccctgtttcctggttttgtaacagagatgctcaaaacgggtctgcggacctttggccgcaaattgccagggtttgacgccgcggatacgcttctgacgggtgtggagacgcgtacctcgtcgccggtacgtataccgcgcggtatggatttttatgcgaccaatgcggcgggggtgatcccgtgcggcgagggcgccggatatgcgggcggcattatgagcgccgccgtggatggcctgcgcgcggcgcttgcgcttatggcggtatatggccggccggctccgcgctgatggtcaaaggacgaagctgcggcatacgatggtaatatccgccgggcctgttcaagagcctgctttgtatctcccgccacagatctttcacactgaaaaattccaagggagcagaatgcgaaacagattcaaagccgtccggcggacagtctgatgaatggggctgccgcgtacggcttggccggatgtacggcatggcccaaggaggtccgccatgaaaatcggcgtcgcattttcagggagcggtgcgtgcgcggccgccgcgcatcaatttgccgcactcctgcaaaagcgttctatagaaatcacgatgctgtcagcgacttcactggcggcggtgccgtcgttgctctggtcgcgcggggcgcctttggaagaaatagataaacagatggatctgttttgcagtgtttcgccgcaaacagggctgcgtcagcttgaaaaagcgggattgttagatcgtccggcagtttgcgattttgcggtcaactgtgttgatgtgtcgaccggcgtgaccgttatttattcagattcactacattccaatgcgtggaatctcaaggttctgccgcttgcgggaaatgaacgggctgcgcttttggccgcgctctgtccgtggggagatgctgaacccgtcgcattggagggaatgcgcctgtgtgatttttccgcttgctacggcagcccgttgttcccgctgaagatggcgggcatggaacggctgatggctgtgtcatttccgggaggcggcacacccgcgcagaccgcggccaatagccttgtctgcctgacgggaaaaaatgcggacttttactgcgaggtgcgccaggagccaaaccgcccgttgtccgaaactgtgtgcgctgcggctgtgcagagcgccgctatgtttggtgaaaagctgcggccgtgagacggacgcttggatttgcaggaaaactgtgctatgatggataaaaatacggctttgagcgcctgttcgttctctatttggagcggataggcgccggaagctgtgccgcgcagcggcacagcgcgccggaggagaggacaagctgatgatggaaaaagtaacgctgatgtgtccctgcctgtttggcttggaaagcgtattgtcgtttgaggtcaagaagctaggcggagagaatattgtggtgacagatggccgtgttacctttgacggggatctttcgatggttgcaaaggccaatatctggctgcgcacagccgagcgcgtcggcattgtgatagggagctttcgggcggagacattcactgagctgtttgaccagaccgctgagctgccctgggagcagtttatcggcgaggacgattgctttcccgtcaaaggctggtcagtcaattcgaagcttttcagcatgtcggactgtcagaggatcatcaaacgcgctgttgtccggcgctttgaaaatgtataccacaaaacattgtttgcggaaacaggcgcgctctaccaaattcaatattcaatccataaggaccaggtgacgcttgtgcttgacacaagtggtccgggcctgcataaacgcggttatcgcgccaatgcgaacgatgcgccgattaaagagacgcttgcggcaggcattgtcgatcttgcgcgcgtgcggggcgattcactcgtatttgacccaatgtgcggctccgggacgctcgtgattgaatcggcgctgcgtgcgctcaatatcgcgccggggatccggcggcgttttgccgcgcaggggtggcggtgttttcaaaacgggctgttcgatgaggcgcggcgcgacgcggcctcccaggtacggcgcgacgcgccctttgaggcattcgcctctgacatcgatccgcaggcagtgcgcctgacgcgtgaaaatgcggcaaaagccggcgtggccgggcggattcatgtcgtacaggccgatgtcacggattttgcgccgcagctccctgagggacgaagcggtattgtactggccaacccgccgtatggagagcgtatgctcggcgaacaggaggcgcaggcgttgtctcgtgcgcttggcgcttcctttccgaagcgtgacggcttcagctattacatcatcagcccggacgacggctttgaggatctgtttgggcgtccagccgcgcgccgccgcaagctgtataacggtatgattaaatgccaggtatacatgtattttgataagccggtccattttaaaaataataaatagctgcgcgatctaaagggggagcgaaatgagacgcttacggcagtgtttgatggtggtgtttttgacaggcagccttgcgggctgcggcgcgttgtgttcaccgttgaaggaacagacgcgtgcaatcgttcaggatgcggtatcagtcgccgtcgatacacgcggcgaggtccaaagagaggtgcgcgccgcgctggatgaagcgtttgaggatgtacccaattggcgtgagcaggtccgcaacgaggtgcgcaggtctttggaggaaagtggtttgtcgtttgcgggttcagccggcttcccagagggagttttatctgaaagcggcctgattggagagcttgttgcggatgagtttcatgaggtgttccaggatgggtggtttttggatggagaaggaaagggcgaacaggtggaaattcaggacgctgatggaggcgtattgcacacactgaccgaccgagcggaactttccaagctgttcgatgcgttccaactcgataaatcgcagctttccgtgcttcctcagaacgctcaggtccaatatgtgtgcgtagtgttccaacagcgcacgcgtctggcaggagatccgccggatgcaccggtcagcctggaacagaccgccgtattggaactgtacgaccagccgtatctgcggatggatatcgatgggctgcgctttactttccaaataccggccgatgcgggggatcgcgttaaggaactcttaaaataatccaagcgcaataaaagaacgcaaaaaaagagacgccgcagcgtctctttttttgtatcttggaaccggaaagtccccgcgtattttctgttctaggaacgcggacgtgctcataagataggggtataaacaaaaaggacgtgatgaaatgagagacgacgaacgctatcttgccgctatacaaacgcttggtgagcatgtgcggcgcgtgctggcacgtgtttcgggcgacgtgcagcgggaaaccacagaaatacgcttgcgtgttggcaggccgctggggctgataacaccggcgcgcatcctgtttgtggatgagaatggcggaattgcgccgcgtcctgcgctcaatgcgtttattgtgacgaaggcggacatgcaggactgtttcgtatcgctgtgcggatgggcggtacacagccaccagcgcgagatggcggacggatacatagcggtgcgcggcggccaccgcgcgggcgtggcggcgacggctgttgtggaggacggacttgtggcgtctgtgcgcgatatcacatcgatcaatctgcgtatagcgcgcgaaatattcggctgcgctgaccaattgatacggggatattttatggacaggccctgcgggctgctgttggcgggtgcgcccgccagcggcaagacgacgcttctgcgcgacctggcacggcagctttcatcgggaacgccgggcgtttaccggaaggtctgtgtggtggatgagagcggtgaaattggcgcgtcttccggcggactgattcaaaacgacttgggtccgtgctgcgacctgttggctggatatcccaaagccaagggcctccagatcgcgatccggtatctgtctccggaaatcattatttgcgatgagattgccacagaggcggagatcgaagcggttgcggcggctgtgaacagcggcgtagcagttgtaacgtccgtgcacgctgcgagctttgaggagctgtgccgcaagcggatgatcggccggctgtttgaaacgggtgcgtttgcttatgccgcaatgctcaggggagctgataaaccggcgcagattctcgcggtcagaaaggtggaggaattatgtatacagccatgaaaatcggcggtatggtcctggtgattgcatgtacaacatcgatcggtatttcttttgcgcgcgcgctgacagagcgtgtccgtgaattggagcggacattggcggcgctgtcgtcgctggggacggagctttcctacagcctggctccgccggctgaagctgttgcgaagctggatgaaagagaaacggaaagcgcggcgtttattccggcgtgcgcgtctttgtgccgtcggggaaagccgtttccgcaggcatggcgcgaagcggcgcttatgtttcacggcgcgctttcccaggaggacgcagagattttggcagggctttccgatacgctgggacaatgcgggctggagggagagctttccagcctggagcatacgcggacgcttttgtccatgcagttggatacagcgcgcgcccgcagcgcgacgcacggccgcctttaccggaccctggggttattgactggcgcgttcgtcattatcttttttatctgaggaacaccgccgaaaggagagaaaacgcggatggacgtcgatctgatctttaaaattgccgcgattggcatcattgtggcggtgctcaatcaggtcctgatccgttccgggcgtgaggaacaggccatgatgacgacgcttgccggtttaattgttgtgttgatgatgattattgtacagatcaatacgctgtttgagacagtcaaaagcgtatttgggctttactgaaatggatatgatgacagtgaccgggctggcggtcgtcgcggtcgcgctcggtaccatgctcaaacagaaaagcccggaatatacgctgttcatttcgctgacagcgggcatcctgatcctcggcatgattgtcgcggccgccgcgcccctgttcgaacggatgcaggccttgttcgcgcagacaggggcgaaggcggaatatgtacaggttttgttcaagtctcttggcttgtgctttatcacacagattgcatgcgacgcctgccgcgaccttggggaaagcgcgatcgcctccaaggtggaagcggccggtaaaatctctgtgctgttgatcagcctgcccttgtttgagcagattttgaatatcgcctccggtctgatcgggcaatgagaatgggagggggtccaggtgaagaaacgagacatggcggctgtctgtgcggcggccgcgctgcttcttttggccgtaccttccgctttggcgctggatggatcggagacggacgcatacagccaaagtatgggggcgtccagttcggcggcttcatatgaaacgcccgccgagtttgataaaacagaggggtatgcatctgaagctgactttaacgcttccgataccagtgcagaaaacggctttacagcgaatgacagcggagcgcaaggcggatatatcgacgcacagccgcttatcccgggagaaacacggattaagacccagcttgacgcggtcggcgcggacgagcttttagaggagcttccggatgatgcaaaaaatctgatggagggcgcggggatcacagagatcgattataaacagctattgacgctgtcgccttcccaattcttcggctccgtgtgggagcttgtggtacagcgtttgcgcgctccgcttacagtgttcgcgtcggttctcgggacggttctgctgtgcgcgctgctcgactgtttaaaaacctccctgtgggaaggctcgctttcgacggtattcacggcggtttcggtcgtttgtatcgcggcggcggtcgtttcgccgattacagactgcatcacaacgacagtagccgctattcacgattattcaaattttatcctttcatttataccaattttttcatcgatcgtcacggtgggcggtcaggcggtcacagcgacgacctatacggcctttctgttcgccgcgtgccaggtggtcagccagattgccgccaatatgctggtgcctttgatgggaatctatttggcgttctgcattgtcggcaacctcgcgccgggaatcgatatcacttctgtcgccaaaacgatcaaatcaacggtttgctgggcgcttggtctgctgctgaccttgtttgtcgggctgttatcgcttcagacgatggtggcgtccggcagcgataccgtcgcctctaaaacggcaaaatttttgatcggcacgtttgtgccggtggtgggcagcgcgctttctgacgcctttgtggcgacgcagggctatatgaagctgttaaagacgaccgtcggcgcgtttggtattcttgccgccttattgacctttctgcctgtcctgcttcaaacggtgctctggtatttcacggtcaatatcacatcggctgtcagtgagatgcttggcgtcaagcaggtggcgtcaattttgaaaagcgcatcggcgacgctcggtgtgctgatcgccgtcattttgtgctttgcgctgctgtttgtcatttcaacgtcactggtgctgatggtttcaaccggcgtgtgagggcctgtcataaaagaaaggagtgtgctgtatattggatggtatcagacaatgggcgttcggcatttgcgcggccgcgattgcatgcggcctggcgcagctcgcgctgccaaaatcgagtatgcagcgcgtgttcaatatcacatcaagcgtcttttttctcgggtgcctgctttcgccgatcgcattgccgtcgatcgatttgacagtgaccccgcagagcgaattgcagcgccggattgatgaaaaaaccgcgaggctttccgacgctgccaacgagcagacaaatatggccgcttcggagggggtgcggctggcggcgatgaaaacgcttgcggatatgggcgtgcaggccaataaaatttacataaacattcatgaggacggggaaggaggcatatctattagtgagtgtgaggtacagctcgacgagcagtaccgaagcaggcacacggaaatccgcggcgcgctgatggagcgcctgggggtcaacgttgtgatcggatatgaaaaaggagtgactacatgaatgggaacaaaccggctgtccgtattccggaccaggtcatcgcatttttcaaagggaaccggagccgggcgttgctatttatcgggatagccggtatggcgctgattttcctgtcaacggttataccggccggcgctggaaaaccgaatccaagcgttggagcggcgcagcaaagcccggaggaatatgtggccgatctggaaaagcggctggcacagcttgtcgggaaggttgacggcgttgggcggtgcgaggtgatggtgacgctcgaaaacggtattgaatatgtctatgccgttgaggaatcacagaatgtcaaccagacaaacagctatgacggcagcgatgtgcggcgggaaacacagcagcagaatatggagcagaaatacattgttgtggatacgggcagcggtaaaaaagaggcgcttttaaaaacacagcgtcagccaacggtacagggcgtcgtcgttgtgtgtgagggcgcgtcgagtaccgttgtgcaggagcgtgtgacgcaggtcgtcgcgacggcgctgggcgttccgtataaccgtgtctgcgtcacaaaaatcagcaaatgaccatacggacatatgggctgcggggtaagccgaattgccccaaaaggccctgatctgcggcggcagttgtcaatatcaaatcaagaggaggaacccccgtaatgaatatgatcattggaaaaaaacagattatcctggcgtcgcttgtggtgggccttggactggcagtttacatcaattaccaatttgcgcagtcggatggcgcgctcacagcgacttcggcgattgaaagcgacaaaaattacggcgatgcacagttggtcgacgcaaatgatccgacggttgaggatatcgacggcgaagcgtatttcgccgaagcaaaggtcacgcgtcagcgttcgcgcgatgaatcggtcgaaacgctcaaaaatatgatggcgagcgcggatgttgatccggatatcaaagccgagatggcgctcaaggccacggaaatcgccaagtcgattgagacggaaggcaagatcgaaaacttgattaaggccaagggctttgaggactgtatggtctattacgacacggaaagcgttgatgtagttgtcaagacggatggtttacagccggagcaggtttcacagatgaaggatatcatcctgaaagaaacaagtatcccggccgagaacatctccattgtggagatcaattagcgcgctgccgctgccgcgcaatctgaaagcgcctcatggacatagctttgtgtccatgaggcgcttggctttatatgaacacgctttgaaacagtataagaatccatttaaatgcctatatctcatatacagaataaataacggtacgacatgggaataggcaattgtaaagcgggaatttttatgctataatatgcgcggaacgattttaacgctatatagcaggttaattcatcgctatcctatcccggtgatgcatgttgattgcttaaaaactgtacagcccggtctgttccatgtctgataaaggagaatgaatatgcaaaatcatgaccatgatcatggccagtcggccggaaacctgaaaatttcacgtgacgttctggcgacgattgcccgctatgcgacaatggagattgagggcgtcgcttcgcttgcgtcgtttacaacaaatattcgcggctggcttcttaaaaagcagtctgcaaagccaattacgatcgatttaaacgacgacatcgctgtgattgacatccatgtcaatattaaggccggcgttaatatcccacaggcagccgaaaaaatccagtctgccgtcaaagaggccgtccagaatatgacggggatcgcggtatcgcgcgttaatatcaatatagccggaattgtatttgatgatccgttgccggcagcggatgcctgacagcaaacagcaagaggggctggtctgcagggctgttcccaaatgcgttcgtatgctgcaaaataacacaataatgccggtttgccggcggaatggacgatcaacatgaagcgaagcgaatcccgcgagcaggcgtttatgctgatttttgaacgctcgtttaaagatgaatcgatcgacgaaattattgaacaggctgcgatcggccgcaatttgcaggtggacgattatgcgtatcgtctggccagcgatgtctgcggcaatttgccgtggcttgatgaggcgattgcatcgtattccaagaaatggaaactcaatcgtatgtcgcgcgttgcgttgtcgattctgcgcctgagcctgtgggagattgaccatgtcgacacagtgccggccggcgcttcaatcaacgaagcagtcgagcttgctaaaaaatacggaaatgacgacgacttttcatttgtaaacggtgtgcttggcgcatatgtgcgaaggaaggattcctctgagcaggcgggggtcgaggagaaggatataaccgaccagggcaatgcggaagctgaaaaagtgctggacgcgccggcagaggcatagcgcgatggcacgttacctgggaatcgacaccagtaattatactacttccgttgcgctgtatgacagcgcctcaggagaagtttggcaaagaaaacagcttcttcccgtaaaagacggcgcgttggggcttcggcagagcgacgccgttttttcgcatgtgaagcagcttggcgcactgattgaggcattgtttcaagagcacggcggcgcgccggatggcattggcgtttctgttcgtccgcgtgatgccgaaggttcgtacatgccgtgctttcttgtgggagagacggcagcgcgatgtgctgcggctgtatgcggcgcgccgctgtcctgcgtgtcgcatcaggcggggcacatcgctgccgcgctttattccacgggacgccttgacttgattgggcggcggttcgcggcctttcatctgtccggaggaacgacggaatgcgtcattgtacagccacggacaggcaatccgctcacagtgaatttgtttgctcagtcgctcgatctcaaggcagggcaggcggtcgaccgggtcggcggtatgctcggcctgccgtttccggcaggcccgcggcttgaggagctggcgcgccaatcgaagaaaacctttcgtataaaagctgcgtcaaaaggcgcggattgctcgctttcgggaattgaaaacaaatgccgttccatgctggacgcgggggaggcgccgtgcgatgtcgcacgcttttgcctggacagcatcctggcggctttgacgcatatgacggtcagcgttcggaacgcttatggagaaatcccgctggtctatgctggcggggtgatgtcgaacgcaatgattcgaaccgctatggagacgcggtttggcggactgtttgcacagccgcagttttccgcagacaatgcggcgggcgcggcagttctggcgcgggtcatgcaggaggacggcgtatgaatcggtcggcggttgtttgtgtctcgcaacttaaccgttatgtaaaggcgctgcttgcttcagatggcgcgcttgacggattgatggtgcgcggagaaatttccaattttctgtgccattataaatcggggcatatgtattttacgctcaaggatgagacggcggcgattaaaacagttatgttccgcggacatgcatcccagcttcgcttcaggccggaaaatgggatgtctgtgattgtcagcggttccgtttcgctttacgagcgggatgggagctaccaattttatgcaacggatatgcagccggacggtatcggcgcgctgcaccttgcttttgaacagcttaaagaaaagcttgcgcgcgagggactatttgacgaagggcgcaagcgcccgctgccgcgttatccggagcggatcggcgttgtaacaagcgagggcgcggcggcgtttcaggatattttaaatattctttcgcggcggtatccgttggcgacggtggtgctttatccggcgcaggtacagggcgagggcgcggcaaaaacgatcgccgacggcgtgcgtgcgctaaatgccgcgcatgcgtgcgacgttatgatcgttggacgcggcggcggctcggccgaagatctctgggcttttaacgacgagacgctcgcgcgtgtgattgcgtcgagcgaaattccggtgatttctgcggtcggacatgaggtcgatttcacgattgcagactttgtggcggaccggcgagcgccgacgccgagcgcagcggcggagctggccgcgccgaatatcgctgacgtacagtattatctgtcggatctgcttgagcggtgcgccgcgcagacacagggacgcgttgcgtcgatgcagcttcgaatgcgcgcgattcaagcgggtatggctgcgtctgaaagcgtcttacaaagtatgaagcagcgcgttaagacgcttgaactggcggtacaggcagcagttgaacggagactttccggcgcctgcgagcaggtgcggtatctgtcggcgctggccgaggaacgaagcccgatgcgtattttatctcgcggttacagtctgacgagcagtaagcggggacctgtctcgaccgttgatcaggtgcgggttggagaactgctgttttcacgtctggctgatggcgagatcatttcccaggtaattgagacaagaggtgttgaacatggcaaaaacaatgacgcttgagtcggctgtcgcgcggcttgaggagattgtctcgacgctcggcggggatgtgccgctggacgaagcggtgaagctgtatgctgaagcagtcaagctggttgatttttccaatggtaaaattgaagcggctcgattgaagatagaaaagctttcagcggcaaaggaggatagcgatgcggtttgacgagcagttcgcctcctatgcgcggcagacgaacgatgcgctgcgcgattgtctgcgttatccgggcgtgcggctccaggcggcggttgtcgatgcgatgcgttacagcctgttggacgccggcaagcggctgcgcgccgcgctggtgcttgagtttgcgcggcttgcctccgcgccgcgtgaaggtgcgatggcgttggcgtgcgccattgaaatgctgcatgcctattcactgattcacgatgatctgccttgtatggacaacgatgattttcggcgtggaaagccatcctgtcataaggaatttggtgagtcgacggcactgcttgccggcgatgcattgctgacgctcgcttttgagacggcggccggcgcgccgcttttgacagatcctcagcgtgtcgaggcggtctgcacgctttccaatgctggcggcgtctgcggtatgatcgggggacaggtgatcgatcttgcatgtgagggaaatacggttgatgaagcgactttggacacgctttgtacgctgaaaacaggggccttgctgcgcgcggctgcacggcttggctgtctggcgggaaaagcggacaaaaagatgtatgatgccgcggaccgttacgcagcggctatgggtcttgcatttcagattactgacgatattcttgatgtcactggcgacgcgcatgcgctcggcaagccggttggaagcgacgcggaaaatcataagacgacgtatgcgtcgctgtttggcgttgcgggtgcgaaagcgcgcgcgattgcgttgatcgaagcggcaaagcgggaaaccgatgcgttttctgataacagctttctcgtttggctcgcagatatggtcttgaaccgcgatcattgatggagcgtacagccgcgcgcacgggcgaacagcaaatagccctgaggcctgtaaaaagcgagtgttcaggacttgtttggaaatagagaattgccgaatttttcgtatcatcatggaaagcagaaatggcccaaagccgggaggcgaatatgaatcctctgaaagtattggtcagcaattatgttattgacgtcgggttccttgcgtggttcgcggcgcagcttctgaaaacaattcttgcatatatcccttcgcgccggatcaactgggaacggatggtcggttccggcggaatgccaagctcccattccgcgcttgtctgtgcaatcgcggttggcgtcgccaaaaaggcggggtatgcggcgccggaatttgcaattgcaatcgcgctggcggctatcgtgatgtatgatgcgatgggcgtgcggcgcgctgccggcgagcaggcgaaggtactgaataaaattgtaattgattttaaagaaatgtttcagatgctccgtgaggaagtggatgcgcttgcgcgcggctcggaggaaggcgagggagaggagaaacgcttgaaggaattcttaggccatacgccgctggaggtactctgcggcgcgctgcttggcattttaatcgccgcgttgattccggcgttttaggattctgcttcgtattttttgccgcggcttccttttgggatgggatattcgggaaaaatgcgaaactggttctaacggcgaaagggggaaaacatgttggcggaaaacagatttctggaacgcttaaatcttcctggagatttgaaaaaactcagcccgagtcaacaggatattttatgttgggagctgcgcagccaattgctgctgactgtttcggaaaatggcgggcatctggcatctaatctcggcgttgtggaattgaccgtggcgcttcatacagtgttcgatattccgcgcgatgaaattgtttgggatgtcgggcatcagtgctatgtacacaaaatactgacagggcggctgaagcagttctccgaaatacgtcgtgagggcggtctgtcagggtttcccaggccgcgtgaaagccgcagcgatgcgtttatcgcgggacatgcaagcacgtcgctttcagcggcctgcgggcttgcaaaggcgaaagccttaacaggagatccgcatcatgtgatcgcggtcgccggggacggagcctttacaggcgggatgatttatgaagctcttaataatgccggacgcagccgcgatcacctgattgtgattctcaatgacaatgatatgtctatatccaaaagcgtcggttcttttgcgcgttacctggccgcaaaacggtcgtctgaacgctataatgtaattaaggagcatgttgaaaaagctgtgcgcaaaattccgcttgtcggaggagagcttcgtaatgtcatttccgattccaaggctgcgctgcgtcagatgctctaccacagcaacctgttcgaagattttggatttgactaccttgggcctgtcgatggtcacgacgtgcggatgctgattcaagtgctgaggcgcgcaaaggagcttaaaaagccggtggtggtgcatgtaaacaccgtcaagggcaagggctatgcatatgctgagaaaaatcccgcgcattatcatggcgtcggcggattcgatccggtaagcggccaattgtctgtgccggcggagtcgttttcagcgcattttggcagttggctgacaatgcgcgcgcgcagggacgaacggatctgtgccatcaccgccgcgatgcgcgacggtacagggcttgaggcgtttgcggaggagtttggaccgaaaaaccgtttctttgacgttggtatcgccgaggagcacgccgtcacctttgcatgcggtctggctgtgggtggactgctccctgtattcgccgtctattcaacatttttgcagcgtgcctacgatcaattgatccacgacgcatccattgagccgcagcatatcgttctcgcagttgaccgcgccggttttgtcggtgaggacggcgagacgcatcagggtttgtttgacgcggcctttctgtcctcgatctatggcatgacggtctattcgccggcctcttatgctgaactggaatatgcgatggagcgcgcactgtatcactgcaagggtccggtggctgttcgttatccacgcggaggtgcgccggcatccgaagcagatcacgtgccggatgattggctgcatatcaaaaacggcggaaaaacgctgcttataagttatggccgcatcttcagtgaagtgcgcgcagcggcaaaattgttggcagagagcaaaaagccggtcgatttgctcaagctctgccgcattgcgcctttgccagaggaatgcatccgcttggcaagaaaatacgaaacaatttattttgtcgaggaaggcgtccgaaacggcggcatcggcgagcattttctcggcgctcttgcacaggtgcggtaccgcggacgcatgaccattcacgcggttgacgatccgtttgttccgcagatgagcgtacagtccgcaatccggcggtgcggttttgacgcaaaggcgattgccaaggcggttgcagagctttatttttgagatgacttaaaataacggtacggcttttgcatagacgacggccggtcaattggagggcgctgtgaaaaagaggctggatatcctgcttacagaaaaggggtttttcccgagccgtgaaaaagcaaaggctgttattatggctggacaggtctatataaatggccaaaaggctgataagcccgggatggatgttgcagaagatgcagatatagaggtgcggggagacaccctgcgctatgtcagccgcggtggattgaagcttgagaaagcgatgcaggtctggccgattgtccttcaggatcagatctgtatggatatcggtgcgtcgactggcgggtttacggactgtatgctgcaaaacggcgcggctaaggtttatgccgttgatgtcggctatgggcagcttgcctggaagcttcgcaacgatccgcgcgttgtcaatctggagcgcacaaatattcgatatatcacgcgggagcagctttccgacagaatcgatttcatcagtatcgatgtttcttttatctctctgcgtcttgttttaccagccgccgcccagttgctttatacagagggtaaggctgtttgccttgtcaagccgcagtttgaagcgggacgtgaaaaggttggaaaaaagggggtcgtgcgcgaccgtgcaacgcatgttgaggtgttggagcgtgccgtcggttacgctttggagaatggtttttccgtacacggccttgacttttcgccagttaagggtccggaaggaaatattgaatatttgatgtatctgcaaaaggcggctgacggcgctgatctggactccacagcaattgaaacgctcgtcgcacgctcacatgatgagcttgattgactttttgaccgggggacgaaaatggcacaaaaaacagtattgattctgccgaatctgacgaaaaataatacgggacagcttgtaaaatcgatcgtttcacagctccgtttttccgggtgtacgcctgtgatgcaggaagcgtatgacggccaattcgaaaatgtgcggtacgcgccctttgacgccttgattgcggcctgtgacctcgtattgacagtgggcggagacggaaccatcctgcatggggtgaagcatgcagtcgggcatgataagcccgtgcttggagtaaacacaggaaggcttggttatctggcgcaggtggaagcggatgaaatacggattctctcgcgcctggcggcggatgattatgcaatccagcagcgcatgctgctcgagatccgcgtcggcgaggatggcgatccgctgtatgcgctcaatgatgtagtgatctcgaagggcgatttggcaaggatggttgatcttgatatcagcggggacggtcaggcaatcgggagctaccgggcagacggagtgattttagctacgccaaccggttcgacggcttattcactttcagcgggaggaccgattgtcgatccatccatcgatacgatcattgtgaccccgatttgtccgcattcactcaacgaccgtgccgtactgctttctccgcgtatgcgcctgcgcgtgcagagccgttatatcaatgcgtctgacaaaatcgttgtcagcgtggatggcgagaatgtcgcgttgcttggacagaacacgccgattttaatccgtatggcggagaaaacagcgcgttttatcagtttcccggaaaagacgttcacgatgattttgcgcgagaaactcaagccgcgcggttaggcgcagcgcgctctggttagatgggggtatcgtatgaaggcaagacgtcatgcaaaaattctggagcttatcaattcacggccgattgacacgcaggacgagctgcttggcctgcttggtgaaaatgggttttctgtgacacaggcgacggtttcccgtgatatcaaggagcttaggctcgtcaagaccctgaccccggacggcaaatatcactacacagcgcacacagagcatccaaaaagtgagatgttggataaatttctgctcattttttccgaatctgtgcgcgagatcgattctgctggaaatatgctggtgatcaagtgctttaccggaatggccaacgctgtctgcgcggcgcttgatacgctgcattggagcggggttgtcggtacgcttgcgggcgacgatacaatctttatggtgatgcgcgacgaacagaacgcgcatgagcttgtttcgcagctgcgccgcatgatggcgtagcacatgccggctgttggagggagaaaccatgctttcacagctttatattaaaaatgtcgcggtgatcagcgaggcgatcatcgacttttcgcaggggctgaatgtctttaccggtgaaacaggcgcgggtaaaacgatcctgatcagcgcgatcaacgcggtgctcggcgagcgcgcttcaaaggatatgatccgtaccggcgaaagccatgcggtgatctcggctctgtttacagagctttcggccgacgcggctggcgcgctgtcacaagcgggttacgcgccggatgacgacgcagtgctgattatgcgggagctgtcggtggatggcaaatcatcgtgccgtattaacgggcgtcccgcaacgctttccattttaaaagccgtttcggcgcatctgatcaatgtgcatgggcagcatgacaatcaacaactgctgtcacccggaaagcatctcggctttattgatggttttggcgcgctcgatccgctgctggagcaatacagaaccgcttatgaacgatatatggacgccaaacgcgaattaaacgagattgatatggacgaagcagggaaggcgcgccggctcgatcttttgacctatcaggtctcagagatcgacgacgccgatttgcagccgggcgaggaggaggagctttctgcgcagagaaaattgctgcgcaattccctgcatgtgacgcaggcgcttggcgaaagcgtcagcctgcttgacggcggcgacgaatcggcgggggtgacagggctgttcgggttgctggcggaaaatatggagcaggcagcgcgctatatggatgccgccaagcctgttgcggaacgtctgaccgacctttcctatgaactggagggtatttccggcgatattcgtgatctgcttgacggtttggattgcgatccgacgcggctcgacgatgtggaaaagcggctcgacactattttttccctcaagaaaaaatatggcgctgacattgatgatattctttcctaccgcgaccgcgccgctgaggaattggagcgtatagaaacctcggatacgcgtgcgcaggcgctccgggagcagatgatcgaattgaaggccacagcgaagcaattggccgcaaagctcacaaaagcgcggctcgatgcggctgaccggttcacgacagaggtacaggcggagcttgcatttctcgatatgccgtccgtggcgctgtctgtacggcgcacggataagcctttatctgcggacggagcggatgatgtggagctgttcatatccacaaacgtgggtgaggaagccaaatcgcttgcaaagatcgcgtccgggggcgaactggcgcgcattatgctttcaattaaaaacgtgctcgctgaccgcgacgctgtgggaacgcttatttttgacgaggttgacacaggcgtctccggacgcgcggcgcagaagatcgggcagaagctcgcgcaggttgctgtgcagcggcaggtgatcgttgtgacgcatctggctcaggtggcggcgtttgcgcagacacatctgctgattgcaaagacggcgcgtgacaaccgtacctttacatccatcacgccgcttgacgaggatgcgcgcacgcgcgagctggcacggattatcggcggcgagccggtcagcgggatcgcgctccagcatgcgcatgaaatgctggaaagtgcgaaaaatgcacgataaagccgcttgtgcttttaaatagagcgtggtatactaggggctgtctgaatcgggcgtatgcttcggtttggatggagttaaattgaaattataaggagaaagatcgatgacagtttttgaggaattaacccgacgcggcttgattgcgcagatgacacacccggagaagatcgaagaacttctcaatggcgagaaggttacgttctatatcgggtttgatgcgaccgccgatagcctgcacgtcggccatttccttcagatggttgttatgaagcgccttcagcatgcagggcatcgcccaattgcgctgcttggcaccggtactacaatggtcggtgatccgaccggtaaaacggacatgcgcaaaatgctctctgttgaggagatcaaccacaatgccatgtgcttcaaacggcagatggaaaaattcatcgatttttctgacggtaaggcgctgatgctgaaaaatggcgattggctgcttcacctcaattatatcgagctgctgcgtgatgtcggcgtccatttttctgtcaacgaaatgctgacggccgaatgttttaaaacccgccttgaaaaagggctttcgtttattgagttcaattacatgatcatgcagagctatgactttctcaagctgcaccgcgactacggctgcatgatgcagcttggcggcaacgatcaatgggcgaatatccttggcggaatcaagctgacgcgccgtgtgaccggagatgacgtatacggcatgacgtttacgctgctgaccacaaaggaaggcaaaaagatgggcaagacggaaaacggcgccgtttggctcgatccggaaaaaacctcgccctatgaatttttccagtactggcgcaatgtcgcggacgacgatgtgatcaactgcctgaagcttttaaccttcgttccgattgaggagattgaggcgatggaaaagtgggagggcagccagctcaacaaggcgaaggaaattcttgcgcacgaattgacaaagatggttcatggacagcaggaagcggacaaggcgttggaggctgctcgtgcgatttttgcgggcggcacgcacagcggcgatatgccgacaacctcgctggtttcgtccgatttggcggatggtgcgatttctgtcgcggatctgcttgtcaagacgggacttgcgccatcgaaaggagaggcaaagcgcctgattcagcagggcggcgtctccgtcgatgatgtaaaggtttctgactttgcggctgtaattggcaaagaaagctttgacaaggggcaggttatccttaaaaaaggtaagaaaatttatcacaaggtcctgctcggataaggaggcgcgtatatgcgcggacgtatgtccaaggcaaaggctctgacattggtcggtttgctggctgcggtcgaggtggtgctgactttgacgccgctcggctttattccgctcggcgtgaccaaggcgacgacgatccatatcccggttatcctgggagccgtgctgttggggccggccgcgggagcggtgctcggcggcgtgtttggcgttttgagcgtattgacaaacacatttcagccgacggttacgtcgtttgtatttacgccgttttatgcgctgacgcccgatttcagcggcaacggctggagtttggccgtggcgattgtgccgcgtgttttgatcggggtcgtttccgcatatatgttccgcgcgcttgcgcgcttttcaaagagcggctccgccgctttgatcggcgcgggaattgccggttcccttaccaatacaatccttgtgatgggcggcatttatctttttttcggtgaaagctacgccgctgcaaagggcattgctttttccgcgctgtttggagttatcatgggagtgatcgggatcaacggcgtgcttgaggcggttgtcgcggccattttgacgcttgcgcttggccggccgcttttgaaggcattttcccgcccgtcttaaaatttatgcttgacaaatgcggattgccgcgttatgattacacacaggaaatatccaaaaaggctttgacagggaacaaaacacagtttgtgcgccacagagagccgccggttggtgtaaggcggcgccgcttttgtgaataactcacccttgagccgccgggcgaacgcgctttgcaagtagctttcggacgggatcccgccgttaaaagggaacgcattgttcgatgcggctgagcgggctgttaatcagccaatcaagagtggtaccacggaagttgtcagaccttcgtctctttatcaagaggcggaggtctttttgctgctttgccgccgtttacagatcagcatgaaagaaggaatcagcatggcacgaaaaatcaaaatctttgacacgacgctgcgcgatggggaacagtcgccggggtgcagcatgaacttcaatgaaaaaattgagatggcgcgtcagcttgaacggcttggcgtcgatatcattgaagcgggctttcccgtttcatctcctgacgatttccgggcggtcgaagcgattgcgaaaacaattaaacaatccacagtcgcagggcttgcgcggtgtgttgagggcgatatccggcgtgcttatgaggcggttcgctgcgcgcagtcgccgcgcattcatacgtttcttgctaccagcggcgtccatatgaaatataagctcaagatgacgcctgacgaagtgatcgaacgcattacagcaatggtcgggctggcgcgcgggctttgcccggacgtggaattttcggctgaggacgcttcgcgcagcgaccgggattttctggtacgtgcgttcgacgccgcaatcgcagccggcgcaacgacgatcaacatccccgacacagtcggatacagcaccccaaacgaaatgtttgatctcgtttcctatgtccgcacgcatctgaaaaatccagacgttgacgtttccgtacacaaccacaatgatctcggtatggcggtggccaatacgctggccagcatccaggcgggcgcgtcgcaggtggaatgtacggtcaacggtatcggcgagcgcgccggcaatgccgcaatggatgaaattgtgatggcgctgcgcacgcgcggcgatatgtttggctgctcgactggtatcaatacacggcagatttaccgcacaggcaagctgctctccacgattaccggcgttgggatcgcgccgaataagccgattgtcggggcgaatgcgttcgcccacgaaagcggtatccatcagcacggcgtcctggctgaacgcacgacctacgaaattatgagtcccgacgacattggtatctatcaaaacaagatggtgctcggcaagcattcgggtaagcacgcctttgcagaccgtatcgccgaacttggatacaggatgtcggaggaggacattgccgaagcgtttgaacgattcaaagcgttggctgaccgcaaaaaggagatcacggaccgcgatatcgaggcgctgatcggcgcgtcggccattacagatgtacgggaggtctacgcgcttaagagctttgtcatcaacagcggtacggtcatttcagcaacggcggttgttaagctgtcgcgggacgatggaacggagtgcgagcatgtggcgcgcggcgagggtccgattgacgcggcgtttaatgcgattgaccggattgtgaagatggatacaaagctggagaactggacgatgcaggcggttacagaaggggaggacgcgctcggtgaagcgatctgcaagatcaaatgcggcgaccatatcgtgaccggccgcggcctgtcgcctgatattcttgaatcgagtatacgcgcctatatcaatgcgatcaataaggcaattgcaatggaggaaaaggctgcgggctgattgacgatagacggagggatttattatggcgatgacaatgagtcagaaaatactggcaaaaaaagcaggacttgaccatgttgagccggggcagttgatcaatgcggatgtcgatcttgtgctgggaaacgatatcacgacgccggttgcaatcgatgaacttgagaagtgcggctttgagcatgtattcagtaaaacggggattgcgattgtgcttgaccacttcgttccgaataaggatatcaaggcggcgcagctttcaaaacgctgccgcgactttgccgcgaagcatgggattgtccatttttacgatgtgggcaggatgggcatcgagcacgcgctgctgccggaacaggggcttgtcgcgcccggagaactgatcgtcggagcagacagccacacctgtacatacggcgcgctcggcgctttttcgaccggttttggttcgactgatatggcggctgtgatggcgacaggaaaatgctggttcaaggtgccggcggccatccgttttgagctttcgggaaaaccgcaggaatgggtgagcggcaaggacgtgatcctgcacatcatcggtatgatcggcgttgacggcgcgctgtatcaatcgatggagtttggcggggaaggtctgcggcatctgtcaatggacgaccgtctgacaatggcgaatatggcgattgaagccggcggaaaaaacggtatttttgaggtggatgaagtgacgcgcgcttatacacagggacgtgtcaaccgcgcctatgagacgtttatgcccgatgacggcgcggcgtatgcgcgtgtgatcgagatcgatctttcatcaatccgcccgaccgtcgcgtttccgcacctgccggagaacacacggactgtcgatgagacgggcgacgtaaggatcgatcaggttgtgatcggttcctgtacaaacgggcgtatcggcgatctcgccgccgccgccaggcttatgagcggcaaaaaggtagctgacggcgtgcgctgcattatcatcccgggaacacagcagatctaccgtgaagcgatccgcgctggctatatcgatacatttttggacgccggctgcgcagtttcgacgccgacatgcggcccgtgcttgggcggctatatgggaattcttgccgaaggcgaacggtgtgttgcgacgacaaaccgcaactttgtagggcggatgggccatgtcaaatcggaggtttatctggcttctccggcggtcgcggcggcaagcgccattcggggaaaaattgccgatccggcgtcgatctgaggaggaaagcagtatgaaagcaattggaacagtttttaaattcggcgacaacatcgatacggatgtgattatcccggcacggtgcctcaacattaccgaccgcagggagctggcgtcacactgtatggaggatatcgaccgcacgttcgtcaaacgcgtgcatcctggagatctgatcgtcggcgggttcaacttcggctgcggctcatcgcgcgagcacgcaccgatggttattaaagaaaacggagtgtcttgtgtgatcgccaagacgtttgcacgtattttttaccgcaatgccatcaatatcggcctgccgatccttgagtgccccgaagccagtgattcgattcaggacggagacaaggttgaggtcgattttgatacgggtatcattcataatgtgacgcgcggcgagacgtatacggccgcgccgttccctccgtttatcaaggagatcatcgatgcaaacggcctgctcaacgcaatcaggaaaaaagggcaacaatcataaggaaaaacagcgtgcattttgccggtacgcgcaatcgggaaggatattgatatgaagtatacaagtacggttatatctgtagcggatatcaaggccgcgagagcgttttatgaagatttattcggattggaactgtatcaggattatgggatcaatatttcttttacgtgcggtttagctttacagcaggactttgattggctggttcatttgccgaaagaaaaaatattgaagaaaccaaataacatggagatctgttttgaggaacatgatttcgatggatttttagacaaactgaaaaaatacccggatattgaatatctgggagacgtgatcgagcatggctggggacagcgtgtcatcaggttctacgatccggacggacatatcattgaagtcggcgaagatatgaaaatggtaatcaatcgttttcttgattctggtatgacgatggaagaagtatctaaaaaaatggatgtttccgttgaggatttaacaaagctgttaaatggttaaacatttgtttgtgatctgcacgcgtatcagcgagggccgcacaaatgagagaacagttttgatggagccataacgtcggatactaaaacaggaaggcggaacataagtgttccgccttcctgttttcatctgaaaatttctttatatgcatcgagggccgcttgatatactgtgtcaaatggcgcgtcatgcatccgcgcggccgcgcggacatcgtcgtattcaggcttttcctttctgacgccgttcccgctgctgattttaatatgtactggaccgtatggcgtttcaatctgcgttgtttcagccgatagcatcacacgttcgcagagccgttcgcgaacaccgcgcgtcgaggtgtgcagcaaaatgtgccgcgccagctcgtcctttttatccggagcgcacaggcaggtaagcagaacgccgggccggttttttttcatatggacaggcgtcaggaacacatcaagcgcgccgttttcaaataaaatctcctgggcaaagccgagcgcctcgggcgtcatgtcatctatattgcagcaaagctcgcagatctgcgcgcgcaggccagatgactcgccaagaaacgcacggacgcaattggcgcggtcaaaatccttcgttcccattccatagccgatacgttcaacggccatcggcggcatcggaccgaattccgatgcgaagtgacgcagcagggcagcgccggtcggcgtgcaaagctcgccgcgcactgaaccgccataaattggaacgccgcgcaaaatatgtgcggttgccggggcgggaacgggcaaaacgccgtgcgcacagcgcacttctccaaaaccaacatggacggcggacgcagtgatccggtcggcgccgatcagatcgaacagcaggcagcagccgaccacgtcgacgaccgcgtcgatcgttccgacctcgtgaaaatgcacctgttccaccgggacgccgtgtgcatgtgcttccgcctcgccgatcagccggtagacggcacaggcgttttcacgaacacgctgcggcagcgcaagccccataataagcgcgcatatattttgataaccagagtgaacatgtgtatgcgcgtgcgtgccggtttcatgggggtgcgggattgcgtggccgtggggatgctcatgactgtggggatgctcatgactgtggggatgctcatggctgtggggatgctcatgactgtggggatgctcatgactgtagggatgctcatgactgtggggatgctcatgactgtggggatgctcgtggccgtggggatgtccatgctcatggatatccccagagctttcctccgcgccgccgatcagcacgcgtatatgggtaccggtaatcccgcatttctgcgacggctcacttcgcacttcgacgccggggagcccaaggccattcatggtgcgcagaaatgtttcctggtcgccgtacagctccagaagggacgccatcagcatatcgccggatgcacccatattgcattcaagataaatcgttttcatttgtccgatcctcccatatgattgatcatgctggccagatacccagcgccgaagccgttgtcaatgttgacgaccgatacgccgctcgcgcaggaattgagcatggataaaagcgccgacaggccgccgaaattggcgccgtagccgatgctggtcggaaccgcgataacagggcaggaaacaagcccgccgattacgctggcgagcgcgccctccatgcccgccgccgctatgacaacacgcgcctgcgcgagcgtatcgaggtgcgccagcaagcggtgcaatcccgctacgccgacatcgtaaaggcgttcgacacggttgccaagagcttcggccgtgacagcggcctcctcggctacaggcaggtcgcttgtgccggccgccgcgacaaccaaataaccgggtgcggttacaccgcttcgctcaccggatacggcgatacgggaaacagggtcgtagcggatatcggcctgctcggataccgcgcgcgccttttcagcatccagccgggtgatcaggacggattgtccgtttttacgcattgcccggacaatcccgacaatttgttccgccgtctttccgctgccgaagatcacctccggaacgccctggcgcagtgcgcggtgatgatcgaccttcgcatatccaaggtcctcaaacggctcgatttttaactgtgccagcgcatgttcgggcgagagggaaccgtcgcgcacctgctgtaataaatgcagaatcctgtcttgttccatctggatgcctcctgtcagcgcgcccgcaaatcgagcagaatatcctcaaaatcggatgaaagaaccgatataatctgttcgcgcagttcgataatacgtacaagctgcgcaaccggcgcctgtatctttgcgcggctgttgtccaaaatgcgtacgcggaaatcggtaagaccgagtgtaaacagggcgttttccgcgcgttcgacccgtccaagcgcgtcctgtgtaatagtcgtccctgtcgggacacgtgtcgcaaggcaggcatacgccggcttgtcgtgcgtaaaaagcccggcctgtttggacagagtgcggatatccgtttttgtaagcccgcaaatgcgcagcggggaaagcacctccagttcattgagagcacgcatacccgggcggtcggcggcctcgtcggaggcgtttgtcccatcgcaaagaacatcgtatccatcggcgcgcgcggcctgccaaagacgtgtaaacaacgcgcgcttgcagtgataacagcgcagcgcgtcgttggcggcgactgccggttctgacagaacgtcgcaatcgagaacggtcagggggacgtggagcatttcaacgaaacgctgtgtatcgtcaagctcaaactgaggctgaaactgagaatgaatgaaataagcatgtacgtcgcatccggctgttttggcggcatacagcagatatgccgaatcgactcctccagaaaaagcgacggccacacgcggatgctctgcaaaaaaatctgatagctgcataaaaatcccttcctgtcaaaaccggatcaaaaaagaaaaaaggcccacatgcacgtgaacctcctggtttgctgcgccgcttctgcggcgttcgtttctctattagtttacaataggaatatgtgcttgtcaattgcttttcttttcgaaacgattatagtatactgtatctgtaaaaggaggctgaagggatgcggattgtagtgatcgacggacaggggggcggaatcggccggagtattgtggaacggctgcgcgcggctttgcctgaagcggagatacttgcggtcggaacaaacgcgatggcgaccgccaatatgatgaaggccggcgcgcacgccggcgcgacaggggaaaacgcggttgtatataactgtgcgcgcgcgcatgtgatcgtcggtccgttgggaatcgtactggccaatgcgatgtttggggaaatttcacctgcgatcgcatgtgcggttgcagacagccgtgcggcaaaggtgctgattccagcggcgaaaaaacatttatgtattgttggtatcgaggagaagccgcttgcgaaatatattgatgaagcggtcgataccgtttgcgctttagctgcgcagtaacgcgcaggctcagaaaaaatcccggcgaaacaattgtttcgccgggattttttgaatcgttcaaacgatcctcagcagccccgtcttctcgcacaatagagatcgcggcagcagagccaacgcggatgggcgaaatcaggccagaaggtattgcggcaatcggccggataaagcccggcacagccgttctggtcgcggcagatacgcatggcgcggtcggcgccgcactcctcctcaatcggataccaagtgcagtcgtttgcgtgggtcgggcagccgctgaccggacggatccggcagtcgttgaccctggttcgggcgcagccgttcgctgtccgggtattgttgttcgtccgtgcctgcgcggaagcacagccgcagcgggctctgttgttgcagccacaaatcattgataatcacaccttttgtctaagaatgaatatatccaaagtacagctcacagtggaagttgcaatcgctgttccttcccattgtatgcgggtgggcgcaaacttgttatcccactggttggacagaattcaatttgtccccttggtttcgacagaaagaaaacttgtccgctccctataatagaatcacgcggtccggtgggcggtgggaaggggcgacatgctttatgacagtgtatgccgacgttctgattgttgtgaattatattgtcaatctgtttatgctcctggcggcgcgccgtattcttggttcagccgctgggcgcgggcgtatgagcctcgcggcgctgctcggggcagccggttctttggtcattttcctgccatacataggattctggtttcagtttttatataagctgtttctcgccgtggcgatggcggcggctgcgtttggcataaagccatggcaaaagcttataaaagctgtctttgtaacttttgctgtgagctttttgttcgcgggattgatgctggcgctgtcgatcgccctcgccccggccggcatgttctattataacggcgtcgtatattttgatatttctgcgctggtgttgattgcggcgaccggcgccgcttatcttgttctgacggtttttgaaaggctgtttctcggacgcgtccatgaaaaacgactctatcatgttacggtttacacagatggcaaaagtgtatctttccaggctctggcggatactggaagcagcctcaaggagccgttttcgggcgctccggtgatcgtctgcgacggtgagattgccaggcgcatacgcccggaggggaaaacaaatttccgggtgatcccctgcatgaccatcatgggtgagggcgcgcttgagggattccgcccggacgaggtgctgatcgagggaacggcgggaaaacttcatacttccgacgtttacatagcggccagccgcgagccaatccgcggcgattatcaggcgttaatcaatccgcagttggttgcagacgagcggatggtatcacaaggggagaggtgtgtttaatatggtagtatttatggcggactggctgcgcggactgcggctgtggattgacaggctcatatggcggtttcgcttgtggcggcggcgcatcgactatatcaacggaccggaaacgcttcctgcgccgctttcccgcgaggaggagcagattgtgtttcgcaagcttgaggaacacgacgaggcggctaaggagacgctgaccgtccacaatctgcggctggttgtttatattgcaaaaaaatttgaatcgactggcatctgtgtggaggatctcatttcaatcggtacgatcggactgatcaaagcggtgaataccttctgtccgcagaaaaatatcaagctcgcaacatatgcgtcgcgttgtattgaaaatgaaattttgatgcacctgcgcaagaatcagtctcacaaaaatgaaatttcaattgatgaaccgctcaatatcgattgggacggcaatgagctgctgctttccgatattctggggaccgatccggacagcatcaaccggccgattgaggatgaagcggaaaaaaatctcctgcttggagccatcgaccgcttggacggccgcgaacgcatgattatgcagttaaggttcggactgttgggagcagaggaaaaaacacagaaagaggtggccgatatcatcggtatttcacagtcctacatatcccgcctggaaaagcgaattattaaaaagctcaaaaaggatcttgaaaagacgatgtagccgcacgatcatatttgtcggggtggagcgcttttccgcataaaatcgaaaacgcctttcttcaaaacgatgtacaatctgtaaaaaaattttagtgccgactctttcttttttccagagattgccgaatatataaaatatacaggttttaagtttgacaaaggaacggttgttcctgcttaaacatgcagaggaaagaagggcataaaatgaatataagtgcggtttcggcggctggccgcagcaattcgcacgtgggcggctcgcaggatcaggttattatggagatcaaaacgaagattaaagaagtcaaacaggaaattcaaaaagtgaaccgcagcagggatttgaccgatgatcagaaaaaagcgaagcgtgaaatgcttcagacgcagttagacacgctccagcagcagctcacgcagcgccagcagcaattgcgcgaggaacgtcaaaagcaggcggagaaggccgccgcgcaaaagccggaacaaatgcgaagcgaggggggaaacaggcccgctgtcgatgaaaagacagcgagcacgctgattgcgacggatgtggatattaagcacgccaagcgtcttgatacggtgcgtatcagcttaaaggggcaggagaaggtgctggccgctcagaatgaaagcgacacggtgaatctgggcggcgcgcttgagatcaattatgaaaatgcagcggaactgaaagaccgtattcgttcgctggaccgcgaaattggcggccggctcgctgatatgaacggtattggtcagacggaagaaaaagatatatccgttcaaaaggacgaggagcaggataccaataaaaaacaggacggcgcgctggggaaggatgaaaaacacgtcgatacctgggcataaattgaatccggcaaatgaggagcggagaggatgttcaaggcgacatcctctccgctcctcattgcggtcaggcaagttaaaaccaagcaatttctggtaagcgcatgtttttcctgtggatggctcatactgaattcagaatgatatgtctgaacgaggtgcgagcgtgtattataataaagtggaaatatgcggaatcaacacatcgaaactgaccgttttgaaggaaaaagaaaaaattgagctgctgaaaaagattcggcaaggcgatcaaaaggcccgtcaggaaatgatcaacggaaacctgcggctggtattaagcgttgtgcaaaaatttacaaaccggggcgagaatcttgacgatctgttccaggtcggctgcattgggctgatcaaggcgatcgacaactttgatccaaatcagaatgtccgcttttccacctatggcgtaccaatgattatcggcgagattcgccgccatctgcgcgacaataattccgtgcgcgtcagccgctctctgcgcgatttggcgtataaagcgatgcaggccaaggaggcgttgatcaaccgcaattccaaggagccgacagttgaggaaattgcaaaggagatgggggcgaaaaaggaggatgttgtgctcgcccttgaggcgattgtcgagccgatgtcgctgtacgatcccgtttattccgatggcggcgacaccatttatgtgatggaccagattggcgacaaaaacagtgaaagcgattggatggacgaaattgtatttcgtgaagcgatgaaaaatctgggcgaccgtgaaaaacagatcttgtctctgcgcttttttggaggcaaaacacagatggaggtcgccaaagaaatcggcatatcgcaggcgcaggtatcgcgccttgaaaaaggcgcgcttgactgggtaaaaaagcatatctgaattgacaatccttcccgtttcgactaagatagaaacattaaggcctgtttgcaaaaaatcgtttgatattttataaacagccaaaaacaaatggggaggaaacgccttgaaggtactcaattttggttctctcaactatgattacacctattcgcttgatcacattgtggcgccgggtgaaacgatcacttcgacaaagcttgaggttttcccaggcggaaagggactcaatcagtccatctctttggcgcgtgccggcgctcaggtctgccatgcgggcatggttggccccgacggcggtatgctgatcgatacgtgcgagcaaaacggcgttgatcaccagtttgttaaaacagtagaggaacgcacaggcaatgcgattattcaggtcagtgcaaagggacagaacagcattgtgctgtttgcaggtgcaaaccgtcagaatgaccgcgcgttcgtcgacgaggtgctctcgcattttggcgaaggcgatctgctgcttttgcagaatgaaatcaatcttgtcgactacctgatagaccgcgcttttgaaaaaggcatggtcatcgcgctgaatccatcgccgtttgatgatgaaatgcgtaaatgcgacctttccaaagttacgatctttttgatgaacgaggtcgaaggggaacagatcacgggagaaaaggagcctgagaagatcctgacggctttcagaaaacaatatccgcagtcgcgtgttgttttgacgcttggaaaagccggcgttgtctatcaggatgcgcagcagacatgccgccatggtatctataaagtgccagttgttgatacaacggctgcgggcgatacatttaccggttattttctggcgggcgtcttatctgatctgccgatggatgagacgctgcgtctggcctcggtcgcatcgtcaatcgcggtttccaaaaaaggcgcgacaagttcaattccataccgcgccgatgtactggcagcaaagttggaacatgagtaaagcgcatcagaaaaacagaaaagcgcccgtgtatctttcatgtacacgggcgctttttattattcaagattgagcttgtgggaaagaataaaatttgtgactataaaacaggcgatgatgctgattattgttacaaccagaccggggaacataatttgatgaaagatccaggcgccctgcatggtaatggcagcgtctgattccagcatcgtaaatgtaccgaaaacgccgtaaataatttctgaaagaagcgattcaacaattgacagtacgatgtatgcgccaaatgccgccaggatacggtgacgacggaacagatggccgagcgaaatggcggtgtagatggccagaatggaaccgatgatcgaaataaacatggttgccaaaaattccgctatcatcagatactcccggggaccgagataaggcaggagatcagccataacgatattccaaagctcgactgttgcgcggaacagattggcattgaacatcataataaaaattgtaaacagcgtaatcgcgatgctgacaattaaccatacagtagaaacgatcagtttgcacaggatatgacaccatgctttgacaggcagcgtgaacatcagatatccttcatcggacagcaggtttttatagaatcgctggatcatgacgataaaggtaacaacaaaaactgcaattgccagcaggatatagacaagcattgcaaggacggcgggaagctgcggtatctcccgaaacgacaggagcaaagcattgatcaaggcaaagatcaccaaagctccataaagcggaagaaacaagcggccggttgcccggaattcatattttaaaagctttcctaacatctgaatacctcccggaacagcgcgtcgaccgacatgcctttttcctcgcggatttgatcgaccgaggccgccatgacgatttcgctgcgattgatgaagatcacgtcctcaagaatttgttcaatatcagagatcaggtgtgtggaaatgataatggtggcccgctcgttataattattgaggatcgtattcagaatatagtcgcgcgcagccgggtcgacgccgccgatcggctcatcaagcagataaagctgggcttcacggctcatgaccaaaattaactgaaccttttccttagttccctttgacatagttttcaggcggtcatgcggattgatattcaaacgcgaaagcatgtcgtatgcctttgattcattaaaatcagcgtaaaaatccttaaagaatccgataatatcacagacgcgcatccaatcgttaagataggtgcgttccggcaggtaggaaacaatttttttcgtctcggttccaattggcagaccagcgacctccaaagagccggccgatggcgtcagcagaccgttgatcagcttcataagcgtgctttttccgcttccattggggccgagcaaaccgacaatacgtccgcggccaacattcaggctgacgttgctcagtgcgcagacattgccataaaatttgctcaacccatgacaggacagaatggcgtccatagttaaataacctccttcgcggcagcctcaaccagcgcaattgtttgcgccgtatcataaccgagcgcgttcattttctggaaaaattccttgatctgctccatggcaagagaatcctttgcctggcggatcaattcggtatcctcggtgataaagcgtccgcttgtgcgctgcgtgtaaacaagtccgtcacgttcaagctccgcgagcgcccgctgcatggtattcggattgacggaagcttccgatgccatatccctgacggatggtaaacggtcgcctgcacgatagaagccggaaatgatccgaagcttgatctgatcgatcagctgcgcataaatcggccggtcattttttagctcccataccaattcatcacccccatgaattttattgtatcaataaactaatacaatgatacgacgaatctttccagatgtcaacccctaatttggaattttacatgctggctactaccaattccgcacgccttcgatgtgaagtccgcgcgcatttgcataagtataactggagagcggacgcatccaggcgtcaaaagtatgtgttgtcacatacggatttgctcccgctttgcagaccaacagggaatgataccatttgccagaagcatcgccaagctgaatgatatctcccaattccagcttctcgattgcagcttcatgtgcaaagggaccgacagaccggtttcctgtcagaaattgatagagatatggtacgccgctccaggcgggcgcacggtcggcggcgctgttataataccaacccataaccggcgtataattcataacgccgcttccggcatagaggcattgggatacaaagctggtgcaatcgccgccgatcccatcaaagctcatatagcgagggttgcggctaaaagcccatttctctgcataggagacggccttttcacggttatatgatacggttgtcattataaaaacctcccgaaaaaatgatactttgtgcatccggtatatagacgcacttatttagtttatgatatgcccgtgtcagttggggcgcttgacttttgagcttaattccattaaactttaatacgttcgcgggcaatcccgcagggatcccattgacgggatgcatatgccattcgctcgctgactgatgagggatggctttttgtgtgttcagacggctgcggaggtggaaatatggcgctggaacgctatgtaatcagcggcgcgaagaaactgcgctgcggatttacaacaggcgtctgtgccgccgccgccgctaaggccgcaacagttatgctgatttctggcaaagcggttgaacaggtggcggtcacgacgccaaacgatatccgcttggtgctggaggttgaggatgcgtcctgtggcgatggttttgcacgctgtgcggtgcgcaaggacgcgggcgacgatgccgatgtgacggacggcacattgatctatgcaagtgtgcggttgactgacaagcctgagattgtaattgaaggcggcatgggggttggccgggtgacatgtccggggcttgaccagccggtgggcgcggccgccatcaaccgcgttccgcggttgatgatcgcgcgctgtgtgcgcgaggcgctcgccgacggcgggcgcggccgccgcgccggtgcgtatattgagatcacagttccggatggagaagcaatcgcgcagcggaccttcaatccacggcttggtattgtgggaggaatttcgattcttggaacaactggcatcgtggagcctatgagcacggcagccctgattgatacaatccgtgcagaaatgaatgtacgccgggcgcaatgggcaggtcccctgttggttacgccgggtaattatggggagacgtttgcggcccagacgcttcatctgtccggcccggcggtgctttgcagcaattatatcggggaagctgtcgattgcgcggtgcggcttcgctttgagggcctgctactggtaggccatataggtaagctggtgaagctggccggcgggatttttgatacgcattcgcgcacagcggacgcgcgtatggagattttaacggcgcatgccgctctggcaggagcttcgcgcgctatatgcatgaaactgatggcgtgcgttacaacggatgctgcgatcgatctgttggaagaatccggaattttaaatctggtgatgcaaagcgtcactgaacgggctggcatatatctttgcaggcgtgcaggcgccttgccggcggaacttgtgattttttccaatgcacgcggcgtgcttggaatgacggatggagcgcgttctatgatggaccggatgcgccgaaatatggaggaacaacaatgaatggtattttttatggcgtcagtgtcggaccgggagacccggaacttttgacattgaaagcggtgcggattatccgtacctgcgatgtgattgctgtgccacgttcctcagaaaacggggagcaggtcgcgttggaaatcgcgcgtgccgctgttccggaactgtcacagaaggaaattgttccgcttgatatgccgatgacacatgatgcagccgtattggaaaaagcgcgtgcacaggctgtggaaacaattataaattatttaaaacaaggaagcagcgtcgcttttttaaccattggagacgtttcaatttattcaacctacggttatttacacggtcgggtgatcgggcgcggttatacagcgaagatggtggcgggcgtaccgtctttctgcgcggcggccgctcgtcttggcgaaagcctgacagaacccaaactgcctgtgcatttaatcccggcagcttatggcggtgtcgctgagtcgcttgatctgcccggtacaaaggtgctgatgaaatccggcaaaacgctaaaacaaaccatcgacgcgctgcgcgcgtgcgggcgtacagatgtccggattgtgcagcggtgtgggttgcctggagagcgtgtattttacaacttggatgaatgggataatccaggagaatatctttctattgtgatcgtgaaggatggttaaaacatcggctgagtttcctgctgtatggcttcgccgagaaaactgtggtcacagaccgtttttaacagagaaacaaaaaggaggccctgtatggtgcattttgttggagctggttgtggcgcccctgatttgatcacgctgcggggacaccgtctgctgacacaggcagatgttgttatctatgcaggttcgctggtaaatcctgcgctgcttgacaatacaaagccggggtgtgaaattcataacagcgccgaaatgacattggagcaagtgctttcagtcatgaaagccgcagaagccgccggcaaaacaactgtgcggctgcataccggcgacccttctatttatggtgcaattcgtgaacaaatcgatcagcttgctgcggaagggattgcatatgacgtaacgccgggcgtcagctccttctgtggcgcggctgcatcgctctgcgcggaatatacattgccggacgtgtcgcagactgtaatcatcacgcggatggcgggccggacaccggtgcccgaacgtgaggagatcgcctcgctggcagcgcatcacgcggcgatggttgtctttttaagcgccggtatgctggagggattgcgcgaccgcctgctggaaggcggatatccggcggatacgccggctgcgattgtctataaagcgtcatggcctgatgaaaagcgtgtgatcggaaccgtcggcgaattgccggaactcgcacgtgcaaatggaatttccaagtttgcgctgattttggtcggcgactttcttggaaaacagtacagccgttcgaagctttatgatccaacctttgcacacggcttccgggagtctgtccaatgaggctgtcggtcgtcgcatttacagcggcgggagcagatttagcggtgcgggccgccagggccttggagaaaaacgggcataccctgctggatatacgcgtaataaaaagcggcgtttcaaaggagctgtgcagcctttcggaatggacgcgtacagcatttgacagtgatggaatcatttttgtgggcgcgtgtggaatcgcggttcgtgcaattgcgccgtatattcgtgataaaatgacagatcccgctgttgtctctattgacgaacgaggcaggtttgcagtcgcgctgctctccgggcatgtcggcggggcgaacgaattggcgtcgcaggtcgcagcggctgtcggcggtacgccggtgatttcaacggcgacggatttatcgggtttgtttgccgtcgatgtgtgggctgtaaaacaaaatctgtacatctgtgagcgcacattggccaaatcggtatcggccgcgctgcttgaccgaaaattagttggttttcgcagtgattttcctgtggccggaccgttgccggccggcttgataaaaggttcggcgccgcttggcgtctatgtaaccctggacaggcatcaaaatccgtttgaacagacgcttcatttggagccgcgaattgtaactgtgggcgttggatgccgcaggggcgtgaaaccagatgtttttgaaagggttgttttaaatgcgctttcacgcgcaggaatttcggaggatgctgtttgccggcttgccacaattgatttgaaacaggatgaggcatgtatccaggcgttttgtgcttcgcgcagtttgccattggaatgtgtacctgcatccgatttggcggcggttgaggggcattttacgccatcctcttttgtaaaggatgttacaggcgtcgacaatgtgtgcgaacgcgctgcggtttatgcctcacatggacggctgattgccggaaaatgggctgaggacggcgttacgacggctattgctgtgagcgattggacggtacgttttgatgaagcagggggatgcaatggctaattttctggtgtttgccgggacaagcgaaggtcgccggcttgttgagtatctgaatgcctgcggcgcatccgtttgtgcaagcgttgctacagaatatggcaaaatgctgctgcccgaaggtgttgaagtgctgtcaaagcggttggatacatccgacatagcggcgctgctcaaatcgctgcaattggattgtgtaatcgatgcgacacatccatatgctgtactggcgacagaccatattcatgcggcctgcgaggaaaccgggacaccttatctgcgtttgattcggccgtcagatatgccagatgacggctgtgtttttgtggaggatgcagcgcaggctgccgaggtgctggctgcggcgaccgggaaagttcttttgacgacaggtgtgaaagagcttgacgcttttgttcatttgacggattatcaggaacggattttccctcgtgttttaccctctgccgaatcaatacagcgatgtctggcgcttggataccggatacagaatatcattgcgatgcaggggccgtttacgcgcgagctgaatagtgcaatgatgcgtcagatcggtgcgtcgattgttgtaacaaaggagtccggcggtgcgggtgggttcgctgaaaagcttggagccgcgcgcgatgctggtgcgattgcggtggtgatcggccggccgcgcacggaggttggattgacttataacgagcttgtggagcggctgacgcgcgattttggccttcagccgcgcacggcgtccgaaggctcgggaaccgccgcacggcggtttccgctgtttgtcaatttgacaaacagcaaaatcgcgcttttcggcggcggcgctgccgccgttgcacgtgccgccgcgctgctgccgtattgcggtgctctaacggtcgtttcagcgcatccatctccggaattggaggcgcttggtgttaccattctgcgccggtcatatatgcagggcgattgcgcgggatgcgagctggtgtccgcagcaacaggcaacctggagattgaccgggcaatctgcaaggaagcacattctgccggaataccggcggaatgtgcggctgccccgccagaaggagcgttttgtatcccaacggtactggatggaccgctgctcacgatcgggatatatggtgataaggcggctgtggagcggctggcgcctgacatgaagtcgcttttaaatcagaaacaggagccgtttgattaagctgggggaaatgatgaatatttatttgatcggcgttgggatgggaaatccagagcttctgaccggacaggcgcgcgcagctattgatcgcagccgcctgttgatcggtgcgcgccgcctgctggagaagtttgctgaggggatggtggaaactgcgcaggcgaacaccgcagagcaggcgctgtcagtcttgcgcgcttataccggacccggccctgtggctgtgctcgcgtccggggatgtgggattttacagcatcgcaaaaaagctgtctcatatgcttgacggtgcagagataacctttttccccgggatcagcagcttacaatatttctgtgcacgacttaaaacggcttgggatgatgtgaaggttgtcagcctgcatggacgcgtcggaagcctgcctgatgaagtgcgctgtcacagacgcgtctttgtgttgaccggcggggaaaacagtgtgcaaaatttgtgtgcggagctgacggaagctgggcttggcagcgtatatgtatcggtgggggaacgcctttcttatgcggatgaaagggttgttcaggggacggcgcaggaactttccgggcagaccttctcgtccctgtgcgtgatgttggtagaaaacagacgtgcgatgccctcccctgtaacgcatggattgccggatgatatgtttacacgcggcgatgtaccgatgacaaaagcggaggtccgcgccgtatcgattgcaaagcttgggctgaaaccggagtggatcgtatgggatatcggcgcagggaccggttcagtcgctctggaaatagcgcgtgtactgcgtggaggaatggtttacgcagtggagaaaaatgaaaaagccgcggcattgatcgaagaaaacaagcggcgtctcagcgtcggccgccttgagattgtcagcggcagcgcgccggaggtcttggcgggtttgccggcgccggatgcggtattcgtcggcggctcatccggcgcgctgaatgaagttatacagattgcgctggggaaaaaccgctgcgcgcgtgtcgtggtcaacgctattacattggagacggtgcattcggctctggcgtgttttgagcaattcaaattggaggaaccggagatcatacaggtgacggtcgccaaggcgcggacgattgggcacagccatatgatgatgggtcaaaatccggtttatattttaagcgcggggggccatacagatgacggctaaaccgcttgcgcgttttctgctcacggccgtgtcctcgggaagcgggaaaacgaccatgacctgtgcgattctgcgcgcctggctcaaagccggcgagacggttgcatcgtttaaatgcgggccggattatatcgacccgatgtttcatcgcgagagtgttggcgccaactattctgcaaatttggacctttttctgtccgatgaggatactgtgcgccgcaatttggcgcgttgcgcggatttggcgcagcttgcactgattgaaggcgttatgggctattatgacggcgtggcctgtacggacgaagcgtcctcctgtgcgttggcacgcgcgaccgccacgccggctgtccttgttgtggactgccgcgggatggcgttgtccgccgccgcgctcatcaagggctttatgacctttcaggctgacagccggattcgcggcgtgctcttaaatcgctgtccgccagcggtctattctgggataaaagctgcaattgaacagtcctgcggcgtaccggtgctcggttatctgccgccgatgaaggactgcgtgtttgaaagccggcatcttggactggtgacggcggaggaaacccacaacttacagcaaaagctggacgcgctggcggtgcaggcggaacagacaatcgatcttgcggcgcttgcggcgctcgcgcagtcggccccgccgctggtctttaagccgctggaggccgcgctctccttagacgctccaattattgcagtcgcgcgcgacgcggccttttgcttctactacgaggaatcgctcgcacttttgcaggagatgggcgcgcgcctgatttcgttcagccctttggaagatgaatcgctcccaatgggatgctgcggccttttgctcggcggcggttatccggagttatatgcaaaacgtctttcagaaaatgtttccatgcgcgccgctgtacgcggcgcgatcgcagccgggatgccgctgattgccgaatgcggcggctttctgtatctgcacaggacgcttgaagggatggacggcgaacggtacccgatggcgggtatcatcaatgccgacgcgtttcgcacgtcccgtcccgtccggtttggctacgcggcgctgacggcccgccgcgataatatgctttgttatgcgggcgaaacactgtatgcccattcatttcattactgggacagcacagatgctggcgacgcgtttacagcgcaaaagccatatcgtgaccttcagtggaattgtgtccatgcaggtccgtccatttatgccggatttcctcatctctatctggcggggaatccatctgccgctgcgcgctttttggaggcggcgcgcgcttatcatgaaagggggccattgctttgatgctcgaacagcttctggcagcgatccagccgccgtccgcagaggcaaggtcgcttgccaaaaggcggtgggacagcatcgccaagccgctcggaagccttgggcttcttgaggatgcggtgatagagatcgccggtatccgagggaatactcaggtgcgtttggaccggcgatgtgtcgtcgtattctgcgcggacaacggtatcgtcgaagaaggcgtgacgcagacaggtcaggaggtgacagccgtcgtctctgaaaaccttgtcagcgggaaaacaagcgtctgcgccatcgcccgcgccatgcgctgtgatgtgcttccggttgatatcggcgtcgcgcgcgacctggccgacggcctgcttgttcataaaatcgcctatgggacgggcaatatcgcgcgcggaccggcgatgacgagggcacaggcgcttgacgcgcttttgttcggcgcttcgcttgctgaaaagctcaagcgagacggatatgatattctggcaaccggcgagatggggattggcaacacgaccacttcaagcgccgttgcttccgttctgatgggacgttcatccgcggaggtcacagggcgcggcgcggggctatccgcagaggggcttatgcgtaaaatcgacgcgattaaacgtgcgatctctgtgaaccggccggacgtgaacgacccggtcgatgtgatcgcaaaggtcggcggattcgatctggctgggatgacgggtttatttctcggcgccgccgcctgcaaaatcccggtgctgatcgacggcttcatctctgccgtcgcggcgctggcggccgcgcgcctgtgcccagacgccgccggatacgcgcttgcaacgcatttatcggacgagcctgccgcgcgtatggtgttggagacgctcggcaaacgccccatgattacggccgggatgcgtctgggagagggcacgggtgctgttgcggcgctcggccttttggatgcagcggttgcagtctatacggatatgagtacatttgacgatattgccatcgacgcttatcagccgtttgacgagactgcggggacgcttctatgctgacgctggtgactggcggcgcagcgagtggcaaatctgaatatgcggaacggcttgccgctgcatgtgatgggcctcgcgtctatatcgctacgatgcggccgcttgataaagagtctgtcgcgcgcattgaaaagcaccgtgcggcgcgcgccgaccgcaggttttcgacgattgaacggtaccatgatttaaaagggctgcgcctgccgtgtgggacaaacgccgttttactggagtgtatgtcgaatctggcggccaacgagctgttcggtgaaggcagcgcgggcaaggccgctgtgagcgcgatccttgacggcgttgacgcgctgtgcgcgcaggcgcgcgatgtggtgatcgtctccaacgagctgttttcagacggtgaagcatatgcccccgagacactgtgttatctggatgtgctcggcgaaatcaaccgcacggtcgcgcagcatgcgcatcgggtgatcgaggttgtctgcggtataccggttatccacaaaaatgagggggagagagccggatgaggcagcttttacggtcgctggcaaccgccttttctatgtattcatccatcccggtcccgcgtgtcgaatggcgtgaggaaaacatgcgttatgtgatgtgttttttcccgctggtcggggttgtcaccgggccggcaatctggtgttggctgtggctttgccggcaatttggagttggcgcgcctttggccgctgtcgtctgcacggcgctgccggtactggtttcaggcggaatccatctcgacggcttctgcgatacggtcgatgcgcttgcatcacacgcctccagggagcgaaagctggaaattctcagggacccgcacacaggcgcgtttgcagttatgggctgctgcctgtatctgctgattctgttcggactatggatgcagcatgtattttcaccgcgcgccacagccgcgctctgcatcggattcgtacagtcgcgcgtattaagcggcctttcggtcgtaacatttccatgtgcgaaaacaagcgggctggccgcgcagtttgcaaatgcggcgcaccgggcgcgtgtgcgcacagttctcataacatttgccgcgctctgcgcggcggcaatggttgcttgtgcgccggttgccggcgcggcctgctgcgcggcggcggcacttgtatttatctggtatcgcagcatgtcgcttcggcagttcggcggtatcaccggcgatctggcaggatggtttttgcagctttgcgaactggcaatgcttgtggctgccgtgctggttcaaattctgcggatatgaaaatcaacaaaagcgccagcggcgcgggggaggtttcttatgacgctaatcatcggagggcgcgcccagggcaagcgcgcttatgcgctcagtcagacaggcttaggagcggctcatatctgtgacggcggagtttgtccgttcaatgcggcgtttgaccagcccatccttgcccggcttcatctgctggtgaggcggctgatgcaggtcggccaggatgcgcggcagatcattttaaatggtgcggcggcacatcccgatcttacgatcatctgtgatgaagtcggctgcggcgttgtgccggtcgatgcgtttgaacgtgcgtggcgcgaacaggttggacgcatctgctgtgcgctcgcagagcaaagcgcgcgtgtggtgcgcgtttatgcgggaattccgacaatcctcaaggatgcctgacatggagctgcttttgatcaggcacgcgccgacgcccggaaatttggaaaaacgttatattggccgcaccgatgaaccgattatgcagccgctgcccgttcccattccaagttatccgcaggtggagcgcgtctatataagcccgatgctccgatgccggcagacggcgcagttgttgttcggcggctgcaaaccgctcattttggaggatctgcgcgaatgtgatttcggagcgttcgaagggaaaaaatatgcgcagctctgcggcgacagccggtatcgggcctggattgcgggtgagcttgacgcgccgcccggcggcgaaagcgcagcggcgtttcgctcgcgctgctgtgcggcgttcggacatgctgtccgcctgtgcatacgcgacaaaatcgcgcgcgccgcattcgttgcgcacggcggcacgctgatggcgatcctggagcgatatgcaaacgctcgggaggcgcaaagcttttatgcctggcaggcagctcccttatgcggatgggccgcaaaaacaacatctgacgcgtggatacgcgaacaggcgctttttgatattcagccaatagggggatgaagcggtttgtttgactgcatttggacggtggcgcttgggtttctgctggatgtattttttggcgatccgcattggctgccgcatcctgtccggctgatcggatggctgatttcacaggccgagccgtttttgcgccgtgtttttcccgatacgccaaagggccgccgcatggccggggctgtattggcattcatggttccggtcgcctgcgcggccgctgcatggattctgttgtggtgcgctggccatgtgaaccgatggcttgcattgtgtttacagactttgatgtgctatcagttgatcgctgcaaaggatctgtgtatcgagagcttgcgtgtttacgacgctcttaatgcggacgatctgcctgccgcacggcgggctgtgtcgatgattgtcggacgcgatacagaggatctgacgcaaagcggggtgacaaaggcggccgtcgagacagtagcggaaaacgcgtctgacggtgtgatcgcgccgctgttctttcttgcgcttggaggcgccccgcttggctttttctacaaggcagtcaacacgcttgactcgatggttggttatcaaaatgaacgctacatggacttcggacgctggtccgcgcggctggacgatctgctcaactggattcccgcgcgtgtgtcggcgcttttgatgatcgcggcggctgccccgcttgggctggacgcgcgcggcgccgcgcgcatctggcggcgcgaccgcagaaaacatgccagtcccaacagcgcgcagacagaagccgcatgtgcgggcgcgctcggcgtgtgtctggcgggcgacgcgtattatggtggtgttctgcatcgaaagccgacgatcggggatttcattcgcccggtctgcgcgcaggatattccgcgcacctgccggctgatgtatggcgcttctgttttggcgttggttttattcatgggcgtccgaatggctgctgcgattctgctttaaaaacagttgccgcacactgcgcatccactgatactgattatgtggacagtcaagggactgtttgagaatcgaagaatgagggaggttgttttgtatggacagaacggcacacggtggagatctttatggccgccgcgcggcgctcgatttttcatcgaatatcagtccgcttgggcttcccgaaacagtcgggcatgctctggtcgcatcgatggaagcatgggacaattatccggacccattctgccgagatctgaccgccgcactcgcacagcatgaggcggttccaaaagattggattcattttggaaatggcgctgcagatttgatttttcgatttgttcaggcgcttcggccgcgccgcgcactgacgcttgcgccaaccttttcagaatatgagcgtgcattggcggctgtaggatgcagcatatcgtatcacacattgtatgaaaaggacgcatttagactgacagaaaccattataaaaaaaattaatcctgcgctggatgtggtgatcctctgcaatcccaataatccaacgggacaacctgctgatcaggcgctgcttttacgtattttaaaacgctgcgaggcgtgcagggtggttttactgattgacgaatgcttcatttcatttctcgacgatccgaacacacagacaatgaaagaatttttggcagcttatcccaatctggcaattttgcgggcctttacaaagctgtatgctctggcgggcttgcgcctgggatatttgctttgcgcggatggggaacggctgcacgcgatgagtatttgcgagcctccgtggaatatatctgttcccgcacagatcgcgggggtggcggcgcttgccgacgaaggatatgtggcgcgcgtccgccagattgtccggcaggaacgcggatatttaacccaggcgcttgacggaatcggcgcagtggtgttcggctcacgggccaattatatcttttttaaactgaatgcctgccgggatttggaacagcggttggctgaacgcggcattatgatccgaccctgcggaaattatcgtggactcgataatcggttctatcgagcagcagttaaaatgcataatgaaaatgaacaattgatagcggctataggcgccgttttgggggaaatgtgacgatggcgcaggcaattatggtgcagggaacggcttcaagcgcgggaaagagtctgcttgcaacggcgctttgccgtgtttttgcacaggatggctatacagttgcgccgtttaaatcacagaatatggcgctcaattcatttattacggacgacggtcttgaaatgggccgcgctcaggctgtgcaggcgcaggccgccggaatcgccccttctgtctggatgaatcccattttgctcaaaccgtccagcgacacaggctcgcaggtgattgtgaatggcgaggtgcgcggaaatatgagcgcggccgcatattttcaaatgaagcgcacgctcatacctgagattcaaaaggcgtatgataagctggccggacagtatgatattattgtcatcgagggtgcgggcagcccggctgaaattaatctgaaggcggatgatatcgtcaatatggggctggccaggcttgtccgcgcgcctgtgctgttggtcggggatatcgaccgcggaggtgtatttgcatcgctcgccggaaccatgctccttttggaggaggcggaacgcgcgcttgtcaagggccttgtgatcaataaattccgcggggataaaacaattctggccccagggctttccatgattgaggagatcaccggcgtgccggtcgccggcgtgatgccgtatctgcatgtcgatatcgacgatgaggacagcctttcggaccggctggcagagcgccgtgctgcgcaggccgttgatatcgcggtgatgcgtttgccgcatatctcaaactttaccgatttcaatcccctggagctggtcggcggcgtttccgtgcgctatgtcgggcgtgtctgtgattttggaacgcccgaccttgtgattttaccgggcaccaagaatacaatgagcgatcttttgtggctgcgtcaaagcggacttgaagcgttgattaaaaagcatgctgcgtccggcggccctgtattgggaatttgcggcggctaccagatgctcgggcggacgctgtgcgatcccgacggcgtggaacacggcggtgcgcttgatggaatcgggctgctgccggtcgataccgtttttgcccgtgaaaagacgcgcgaacgtgtcacaggtacattcgcgccggccggcggtctgttggcggggctttccggcatgccggtcgaagggtatgagattcatatggggcgcacggattccgccgcgcctttaacctgtctgcgtacgctcgacggcagggaaaaggttgatggctgcgcctgccaaaatgtatatggtacgtatgtacatggactgttcgaccgtgaggaaagcgtacaagggttgattaccgcgctgtgtgcggccaaaggtttggatgcggatgctgtcacagccttcgacgctgcatcgcaccggcaggcgcagtatgatctgttggcaaacgcggcgcgtgaacacctcaatatgaaaaaaatttaccgtattttggaggaaggcatatgaaagggcttattcatatttactgcggcgacggtaagggaaagacaacagccgcaaccggcctggcggtacgcgcggcgggctgtgggatgaaggtgctgctggtgcagtttctcaaaggtcaggaaaccggagagctgcgcgcgctcgcacatattccgggcattacggtgctgcgcggcaaggcgagtgaaaaatttacgtttcagatggatgagcgtgaattgcagcagacgtatgatctcaatacaaaaaatctgctcaccgccgttgagcaggcgcgtgccggcgcgtgcgacctgctggtgctcgacgaggtgatgggcgcgctgtcctgtcagctcatcgacgaggatttgctgcgcagccttgtggtgcaaaagccggagcggctcgagcttgtgatgaccgggcgaaatccgccggattggctgattgatgctgctgactatgtttccgaaatcaaaaaagtcaagcatccgtatgaccggggcgtttcggcgcggcgcggcattgagatgtaagggggcgcgtatgacgtatccatttgaaaccatgctgcctgcggacatcgagcgccgcagctttgagatgattgcacaggagcttgacgcacagggcgttcgtctcgatgaagaaaccgacctgatcgttcggcgcgtgatccatacgacggctgactttgactatgcacagaacctcgtcttttcgccgggcgcgatagaagcgggccgcgctgcgctgtccgccggcgtaccggttgttaccgacacgcagatggcacgcgcgggcatcaacaaaaaaagccttgcgcgattcggcggggaggcgctgtgctttatgtctgacgaagatgttgccgaagccgcgcgtgcaaacggtacaacacgtgcgactgcttgcatggataaggcgtgtgcgctgaagcgcccgttcatttttgctgtcggcaacgcgccgacggccctgatccgcctttatgagctgatcggggaggggaaactgcatccggcgctgataatcggcgttccggtcggctttgtaaacgttgtcgaatcaaaggaactgatcctgaaaacggatgtgccatatattgttgcgcgcggccgcaagggcggcagcaacgttgccgccgcgattatcaatgcgctgctgtatggcctggaaggcgcgcgctgaaaacaaggccgcggaaatggaaaaaggcgtacccaaccagcggttgggtacgccttttctgaatcgacgctatttgctgatcagatcgcggataaccgttttgcctgccggttcgagcagcagctcgtccgtatcggcgcgctctttacaggccaggcgcggtttcccattgattttgatcaggcactttccgcatgccgcctgtttgcaggccgcatgcgaaaagaatgcgagcgtatcgtccaaatgtgtataaatatattccagcacattcataacggacaggacctcgtgctcgtccactgggacggtatattcctgcgtataagcgcccttttccgcgctgtaccgccggatcgttgtagcgatggttctcatcggattcctcctgtatctgcggctgattttgccggtcagttcagcttcccgacaacctgctcaatatagtcgatgtagggcatccgctcgcgcggcgtctgcatatacggcgttttaacgtcgtccagccggctggcaagcgatgtattttcgatgactgtatttttaaagaacgcctgattgtcggtcacaaaacaatcctcccggatatggacgccccggctttcgctgcgcagcagggcggactggacaattgcccgcgccgtgagcagcatactgcgcgcttcgaggtaatcgagccactggcggttacagatacggttttgatctgtgacgccgatctgtccgagtgcgttgtcctgcatgtcattcaactgtccaagcgcctgttcgagtttttcaccgctgcggattacagtcagacagccgccggcaatatcctgaatctcttttttgagcgtgccgggacgcggtccgctgtttgcaaacggacggagcagctcggattctattgcggcgagcgtatcgctggatgcggcggccaagccggcttcgcgcgcgtaggctccggcgctgctgcctgcacgcgcgccctcgacaagcatttccgttgtcgcagcggaaacgcggttggcgccgaacatcccgccggcgcattcaccggccgcatagagcccacgcacggcggtttccatatttgcattaacatggacgccgccttcaaaatagtgcgccgccggagcaaccgtcagagcgcgtcccgcttcaaggattttcatgatatccgcatagatacccgttttcagcggcggcaggtctgtgtaaagctcctcaaggatttcctttggatacaaatcaaggtcgaagtatacgccgccggtgcaagtgccctttccagcgttgatttcactttgaatggcgtaagacagaagcatcttgttccattcgctgtccagcgccagacgctccacctttttggagagatatttgtctgtaaaggtttttccatacttgttgcgcagattgccatagccggtcgaaaagaagatatacggcaggatattgccgcggtacatcgatggatacagcgtaactgtcggacagaaggataccatttccatgtcaacaagctccgcgccggcgcgcagcgcagcggcctgtccttcgccgcacagatcggtcgagccgctgttgaccgggaaaacattgtgcgcgccgcctgtcgcaaggacgaccgcttttgccggtaaatagagcagttcgccagagtagagaccgaggcatacagcgcctgtgaccgtcttattttccgtcacaaggtcacagaatatggtatcctccataaattcaacgccgcaggccttggctttggcgtacagcgtgtcgagaatgtccgaaccaaagacggacaattcacgttttccctccatgccgcggaccttcatgccccaatgaaccagctcctccacacgatcggccgctgtttccacaaacagcgataccagttcctggttattgagaaagaatccttcatgcagcaggtcggaaaaccatgcctcgcgcgtatcatttttgttgcagtcgctgatgccaagccgggacaggcttgcaccgtcacaggcgatatcggcactgatattcgcgcccgcaagcagcgtcgcgccgctgcggttcgcttttccgcgcgagattacaagcgtgcgtgcgccggcttcggccgcgccaatagcggcgcgcagtccaccgcctccgctgccgatgactatgacgtcatggggagatgctttctgtatcattgttttcctccgattggccgcccgataaagggcggttctttttagggcctgtttaaaattttatgataataggcctcgtacagcggacgcaccgccattcggccatgccggctgatcaatccgttgtgaaaaccggcaggcggttaaaatccatttccgaaaacgtatcgagcgctttaaaaaatgcatctccatacgctttgtgcaaatccccgcgcacatggctgatcagcatacagccagcatcgccgaacacgtccgatataatgtcgcaataaacgcgccagacatgggcgcaatggtacgtgaacggcaggatggtttccccttttttaagtgcatcgacgcgttcgaacaggtccggggtgatgccttcgtcccggaaatgaaagcggcaggcgccgccgctgtgctgcgtttcgtcgagatcaaggcgcagttccggattaaagccgcgcacaatcgaccggtcgatgtccgcgcagtagcgttcgccgcattccggctctccagcggcgcgaaacacgtctgcccatgggcagcgggtgacgcattcatccacgcagccgggacgcgcgcccattgtcacatcaaaaaactcgggtgtacattcccattcgctgtaagcgaagtattccgtgtagccgagcttgtgcccgtcgcgcagggcgcgcagggccatgcgccggccgcgctgttcaccgtaaaggcgctgcgccatggaaaaggcaagcagccccgtttcaccgtattcgtcgcgcagggcgcggtaaaaagcaagcacaatcgcggcatggtgcttttcattgagcttcatgtgccatcccgtccttcgtcatagagcgtacatgccgcgaaatgtcccggcgaaacctcgcgcagcgccgggtcggctgcggtacaaccctcgtggcgccggtcgcaccgggcggcaaagcggcatcccggcttcggctcaatcgggtttgtaacctcgccgcgtatgatctgcggtttctggctgcgcatacgcagatcgggatggggaatggcattgagcagcgccctggtgtaaggatgaagggggcgctcaaaaatttcggcggatgggccgcgctcgatacattgcccgagatacatgaccataatctcatttgagatatgccgcacaacagataaatcgtgcgtgatgaacagataggtcagaccaagctcgtcctgcaaatccatcagcaggttcagaatttgcgcctggatggacacatcaagcgcggaaaccggttcgtcgcagacaataaattttggattgactgccagagcgcgcgccacgccgatgcgctggcggcgtccgccgtccagttcatgcggataagcgtttgcaagcctgcgcgccaatccaaccttatccataagctccagcgcgcgctgttctgtttgggcgcggccgccgtacagtttgttgacgaccatcggctcccggatcaggtcaataacgctgatacgcgggtccaggcttgaatatggatcttgaaagatgatctgcatctgtgtgcgcacatccttcatctgagctttcgtccgcttcaaaatatcctttccttcaaacaggatttggcccgcgtccgcttcgagaaggcgcagaataacgcgaccgagcgtagattttccgcatcctgattcaccgacaacgccaagcgtttcgcccttgccgattttcagattgatatcgtcgacagcgtgcagcttgccggcggctgtctgaaagtattttttcagtcctgcggtttcgagtaagacgctcatgcctgctcctcctttgcgaaaagatgacaactgatgtggtgcgtgcccgacttatagaggggagggcggtgcgttttacagatttccatacactgcgggcagcgcggatggaatttgcagccccctggcagagcggttgggtcgggcataagaccgtcaatcggcgttaagcggtttttgtgcgccgaaagatctgggatcgaaccaaacaggccaaccgtgtatggatgatgccgatcgccttcgaacaggtcataaattgtaccgtactcgatgatctcgccggcgtacatgatcgcgaccttgtcacaggtctgcgctacgacgccgaggtcatgcgtgatcatgatcatggacgtgccgagctgctccttcagatcgtccatcattgcaagtacctgcgcctgtattgtcacatcgagcgccgttgtcggctcgtcggcaatcaaaagctccggggaacaggcgagcgccatcgcgatgacaacgcgctgtttcatgcctccggaaaactgatgcggatactcgtttcgcctgcgagaagggatgccgaccagttcgagcatctcgcagacgcgcttttcaatatcagccttgctgcgcttgtcgcggttatgaagctccagattttcagcgatctggtcgccgacacgcatgaccggattgaggctggtcatcgggtcctggaaaatcattgcgatcttatcgccgcgcaccgcacgcatggcctcctctttttcttccaaaaggtccttgccttccagaagaattttgcctccggcgatctttcccgtctgaaagggcaaaagccgcaggatggcgagcgcggttgttgttttaccagcgcctgtctctccgacaagcccgagcgtctcctttttacccagcgagaagctcacgccgttgactgcgtggacggtttcgttttccgtttcatagcggactgtcaggtccttgatttccaacagtggttctcccacgtcgcagcccccctttagtttttcagtctcgggtcaagcgcatcgcgcaggccgtcgccaagcagattcagcgaaagggccgacagaacgattgcaagcccggggaatgccacaatgtatgcagaataacgcatatattcgcgcccttcggagagcatcgcgccccattccggcattggaggctggacgcccagaccgatgaagctcagtcccgccgccagcataatcatgaacgaaacgctcatggtggcttggacaataaccgggccgattgcatttggaatgatgtggcgcaaaatgatgcgcgcgtcgccggcgccgcaggaacgcgccgcttcgacgtagtcggagccgacgaccgtcaggatggatgcgcgaaccacacgtgtgaagtacggtgtcatcgtgacgctgactgcgatgatcaggttgcgcatacctgcgccgagcgccgccacgatagaaagggaaaagagcattggcggcaggcacataatcgtgtcgatgatacgcatgatgatgttgtcgacctttccgccgtaatagccggccgcggaaccaagcaggccgccggccagagaggaaacggctgttgtcagaaacgcaatggaaagagaaacacgcgcgccgtggacgacacgggcaaagatatcgcgtccatagccgtccgtcccgaaccaatgctgcgcattgggcggctgaagacgaatagtggtattctgcgccacgaccagcgtatcaaaatcggcgatcaggtcggcaaaaatggccgcgagaataaagattgtgataataaccagccccgccatcgcaggtttatttttcttcatccggtgccaaacgtccgacaggcccccggcgcgccggccggacgccatgcgctccagctgcgcgattttgcgtttgtttgaatgactcatcagatcgcgcctcctatcgtttttgctcgtagcgtgctttgacgcgcggatcgatgtatgcatatgcgatgtccaccagaagaaggacgacgcagaagatcagcgcaataaacaatgttgcagccatcacctgcggcacatccttggttcggatggagttgaccacaaggctgccaagaccggggattgcaaaaacggattcaatcagaattgtaccgccaagcaagccgccgaattccgaaccgatgaccgtaataacgggcagcagagcatttttaagcgcgtgccgccagataacgattttttccgtcgcccccttggaacgcgctgtacgaatgtagtcctgccggattgtttcaagcattgtggaacgcgtcatacggagcacttccgccgcgatcggcagagcaagggcgatggtcggcatgatataatgcgaaaacgacccgattccatttgacggcagccatcccagatgcagagaaaaaagcaggatcatcatcaatcccagccagaaacccgggatggaagccatcagcatggccgataccgtactgatcacatccaggaaggaatactgcttgacagccgacaaaattccgattgggataccgatcaggatgacaagtgcgatgctcgttaacgcaagcttgagcgttacgggaaatctgacgaaaatctcctcaaaaacagggcgtcctgtgcggtatgaggtgccaaaatcaccgtggagcgcatcgcccatatagcggacatagcgcacaacgaatgggtcgttaagccccatttcctcgcgaagctgttccacagcttcctttggcgcagcctgtccgagcatcaggcgcgcgggatcgcccggcgtaaaggacatcaccgtaaaaacgatgatggtgacgccgaacagaatggggatcatcagcagcacgcgcttgagtatgaatctgcccataatgccacttccttgtaagaatctatcatttacaaaacagatcgccggaaggaaggatcatgccctccttccggcattgcgtattcgttaccaggaaaattccctgtaaaggtaccgctgattgttgaccgctttaacatttttcagattcgcattgtaaacgatcgtggaagcacggaaatagcaggggataaaatatgcttcatcggtcagaatctgattgacctggacataaagctcgctgcgtttgtcagcgtcaagctcctggcgggcctgctccaaaaggctgttgacctccggattattcacacggctgacattgaaggtaccgtccttatgatacatatcaaagtacggggaatctgtgttctgatcctccatcggataaccgccgcggctgacggtataatcgccgtcaccgaataactgccaccaagctcctgtttcaaccgggttcagctccagattaacgccgacctcggcaaacatggactgaagcgcctgtccgagcttgttgttctcggtgccctcaccatagaagaagtcgagcgtcagaggattgctttcatcataccccgcttccttgagcatggatttggaaagctccacatcatacggataggtggtgatatcggtggtgtagccctcctgcccttcgacgagaggcagatcggcgacaatgccggtgccctcattgacaagcacatttaaggcgtcgcggtcaacagcgtggctgagcgccttacggacctgcttgtcaaccttttcactgttgaagtttacagtatagaaatagttgctggtggtgctgtcagtggcgaggttcgggttgttcttcgcctgctcaaaatccattgcgctgcaattgaaggaaaggtccgcttcaccggtttcaagcgcgacaaacgctgtgttggagtcggggataattttaaaggtcagtgtattgatcgaaggagcgcccttataatagtccggattggcctccaggacaatttgttgtgcaacatcccactgcttaaatttgtaggcgccagtgccgatcggatttttcgccgcgtcgtctcccatttcggtcatcgccttttcgttggcgatatacatgtatgtaagcatgctcaaaaacggaccgtatggatatttgaggttgatcttgaccgtgtagtcgtcaattgcttcggcgtccttaatcatgaaagagccaaacagcatccactcctcgctgataaagcggttaacgctgtaaacgacatcgttggctttcatctcctctccgttgtggaacttgactcccttcttaagatgaaaggtgtaagaatcgccggcttcattcatttcccacgaatcggcgagcgcggcaacgacctgatgatctggtccgtattccacaaggccgtcaaaaatgttggcgcagaagctgatctccgcgctggagggaagcttaaagggatcgagcgttgtgaaatcatctggaaggatgacaacgaggtcgtcgcgcgcggcgccgccggccgcagcatttccgccctgtgcgcccggggcagaactggcggagccgccgcatcccgcgaacagcgaggcgcttaacgccaaactcagcgccagcgcaagtgtctttttgaacataatggtcctcctcattggaatgtatattaaaggctttgacggccgcaaaacggccggcctttaatccgatttttacatcagggcctcaatttcatcgtcacgatactgccggacgcgtgccaatacagcttcgcattcggctttgtcgtgatatgctccctcacgtatgaccgcgcagaaggtttccgtattggcgatgtcctccaaagggtttttctcaagtatcaggatatcggcgtccattcccggctttaacatccccttgctgccggagataccaaggctgcgcgcggcgttgaccgtggcggtacgcaaagcctgatatggactcattccaaaggtccgggccatgtccgccagctcctcgtgagcggaaaagcctccggtcacgcctggattcgggacatctgtacccatcagaatattgtcggaatgacggacgaacagcctggcccgttcgagttcaccctcaaagtccatattgtcatagcggtgaagcgacttgcgccaagcagtgattttgtcccaatcacggtgccaatagccgcacatggaatcgtaatgctttgtctcgcgtacattgtgatcaagatgtacataattgtaaatggtacgcccgacagtcagggtagggcagaaccacatatcggactcagcaagcatgagcacttcgtcgtccgttttcggcaggcagcttgtatgctcaagcgagtaatagccccaatcgcgcagctcccggaaggagacgttataattaccatgccccatgaccttgataccaaaattgtttgccgcctccataattcgcttgaatgcgtctcgcggaatactgggataagttttgacatactggtaaccgccgttgaggcaatctacgaccgcttgctcggcctgttcaggcgtagttacaatcaatgaatgctcccaataggtttgtccatccgtgagcgggccggtggaatagacctttggaccgaatcgttttccctgttcaatttcccggcaccactgctgcgtttcaggaaagccccacatgttgcggcaggcggtaacgccgtttgccagcagcatttccgtgatttcgttgctgtccatatggacatggcagtcgatcagccctggaagcagaaactttccggtgcagtcgacagtattgactccaagcggctcaatgtgcggggcaattttgaggatacgcccatttgcaacgaacaggtccgtgttataaaagaccctttgatcgtccatcgtgataatggtcgcgtttttcaggatataggtcaagcagcttcctcccttttaatttatcgttttaaaatgataaatcgattggaataaaatgaagttcacaaaaaatgtggatgcatttttgtgaacggttcgatggaagttaaaggatcattggatcattttccatggatttcctaagtatggtaaaattgttggcattggaaacgattttgcataaaataaagtttccgatggaaacaatttcataaaatgaagccgccggatatgcaaggtccagcgggaaaggcgatcaaatgtaatcctttaaataatcggtatacatgcgtataaaatccagaatcagcgcccgctgctcaggcgagtatttgcgatattcgcggtgtgtatgggcgctttttgtttcgtgaaaggcgtaatgcccttcgtacgcttttctgccgagttccgtcagcgaaaaaaatgtttccttccgattgtccttgtactgatagcgccggataaatccgcctttttcaagcttttttgttaattttgagacggtccccttggaaaatcccagatggccggctatctcagtgatattgctgtctgggtaattgccgattgcttctatcatatggatatcactcatatgtaaaaggacgccgcagccataatcgtgcgccttctggttgatcttgtgctcacattcgcataatttcccgattgcttcgtcaagttccttaataaacggatccacacattcgcctccagatcgttggtctgggaaactttctgtataaatattataatctgtttattcatagtttgtcaatattctgaggcttttttcttgtaaaacagcagaataatctccattaagcgtttatgggaaggagcgatggagttttgtgcgtttgtatgtttttgcaattagctgtcaaaaatatctgcaaatatacgattggcggttgacagatgaacagcgagttatttccgatcatagaagaacgtgtgcgcgcagcggcacagacaaaaccatcgggtatccgaagactgaaaaaagccgtgcgcagatggctgcgtgatctgcgcacagcatatgacagcctgcctgctgcaccggatgaagcctgggcgcaatggctgtccgataacttctatacattagagggacatgccaaacaaattctgcgcgatctgcctggttttaaaggctgcggaacagcatgtatgcggctgtatgcagcagttgagcgcgtgtttatggatgggcgcgtggtgcccgatcaggcgcatgtggggcagacgcttctctttgccggcttgttgggtgagctaggagaacgccaattcgattttttatacacggcgctgcgctgcgcgcttctgcgtgcggcggcagacgcatgcgcagagcagacagcgaagcaggaacgggaacggttgatctcctatgcggttgtggaactgaaccgcatttgtgaacttgatttcgacgcgctggtcagcgaatgcagcgcggtcgaagcaattctggcaaaggacccgtccggcgtctatccgcgcatggcggagcagtcacgcagccattaccgccatgttgccgcacgcattgccaaacggtgcggcatggcggagagcgcggtcgctcaggatgtgctcaactgcgctgagattgccaaaggtgaacgcgaacgtcatgttgggttctatcttttaaaccacgatccgcgttcgatccacgcgcgccgccgtgcaatcgcggcgctgacgctgacctggctggcaccggtgctgctgtgcgtgctgatctggggcgtctttcacagcctgacagcggcgcttgtatcctatctgcctctggtggaaattgtacgcgttatcacgtgtgggctggcggcgcggcacgcgtctccggcacatatcccgcggatggagcttcgcggcgacgcgccggagacaatcgtagctgtctccacacttttgccagctgcggcaaaggcggacgagctaagggaacggctggagcagttatatttttcaaacagaggcgatcatttaaaattttgtgtgcttgcagattttaaggaggaccgccggccttataacccgcaggacgaactgaatatggcggctgccaagcgtgtggtggagcagctcaatgaaaagtatggttcgcgatttgcgctgctggtacgccgccgcgttttcagcagtacgcagaacgcgtatatcggatgggaacgcaagcgcggtgcaatcatagagctgatccgcttcctgcgcggcggcgatcccgcgatcgcatgctttgccggcgatcgggagcaattatcacgggcgcggtatctgcttgcacttgacgccgatacacttctggcatttgattcggccgaccgtttgctgtctgccgcggtccatcccttaaaccgtccagttattggaaagcacaatattgtaacagccggttacggaatattggtcccgcggattggcacggatttaaattctgcaaaggcgactgactttacacgaattatggccggggcaggcggcgtttccacatatgagcaggaatgcagcgatttttatcaggaccattttggagagtcgatttttacaggaaagggcttaatcgatattgaaacgtttcatacggtcgtcggccggcgttttccggaaaaccgggttctcagccatgatatactggagggcgcatacctgcgcgccgggctgctctctgatgtggaaatgaccgatggaatgcccgccaatgcgctttcgtggcttgcacgcctgcatcgatggattcgcggcgactggcaaaacctatgcttttttggcagaacgcttcagctcaatggatcgtcccggccaaatcccatcagcgcgctgtcacgttatcagcttttcgataatttacgtcgctcctttgtacccgtggcggcgtttgtttgtgtactggtttctgcctttacagggtggagggcggcaattttgctctgtctgcttgctttcctttcgacggcgttggcgcctctgttcgccgcttttcgcgcgctgctttacggtgggcgattcgcattgtcgcgccgtttttttgcgcgcacattgccgcgtgtatttgagctttgcggccaggcgctcctgtcggttgtcatgacggcacagcaggctgttgttgcgtttgatgcgattgtacggacgctttggagaatatttgtatcccacaaaagattgctgcagtggacgaccgcagcacagtcggaaacgcgcgataccggcttttttgcagtgctgaaaaaaagctggctttcagagctggtcgggctttgcctgttgatttttgcgccgacaagccacggtctggtaaaactgtatgggcttctgtttctgctttacgcgccggcggccgctgcgactgcacgaccggctgtccagaggctgcaagcgcccgatcaatcaggccgggaacgccttttgtcgctgtgtgcgcagatgtttcgttattacgaggattatgcggacaaacacaatcgatggctgccgccggataacgtgcagttttcaccggtggaagcggtggcgcggcggacctcgccgacaaacatcggcatgatgctgctctcctatctggcggcgcgcgactttcactttattgacagccgcggcctgtatgtacgcttaaatcatgtatttgacacaattgagacgcttcagacctggcacggaaacctgtataactggtattccaccgaggatctgcatgtgctgccggagccgtttgtctcggcggttgacagcggcaattacctgtgcgcgctcgtcgcgcttaaagaaggcgtgcgtgagtatgcggctcaggagccgggcctggaaaccatcgcagtgcgtattgaagccattttgaaaaacaccgacttttctgttttttataacccgaagcgccgccttctgtccatcggcgcgggagccgacggcaggctggtttcgtcccattatgattttctgatgagcgaggcgcgcacggcaagctattttgccgtggcgacccgtcaggcgcagtaccggcactggcgtgcgctcaaccgcaccatgtcgcgctgcgggtcctatgcgggtcccgtttcctggacagggaccatgtttgaatattttatgccgcatctgcttttacccgtatatgaggattctctgcttgatgaatcgcttcattacgcgctttactgccagaaacgccgtgcgcgccgcgcaggcgtcccgtgggggatcagtgaaagcggttattttgcattcgacgaacagctcaattatcagtacaaggcccatggcgtccagacgctcggcgtcaagcaggggctggaccgcgaatgcgtcgtagcgccatacgcgacctttttaaccctcccgtttgattttaacggcgcgatgaaaaatcttgaagctctcgagtcgcttggactgacgggacgctatggcttttacgaggctgtggatttcacacctgggcgcgccgcgccgtccgacggcggttatgcggtggtgcgttcctatatggcgcatcatgtcggtatgagtatggtcgcctgcgcaaacgcgctgcttggcgggattatgcaaaaacggtttatgcgtgaccacgctatgcgcgcggcacgcgaatttctgcaagaacaaatttctaaggatacggtggtgtatgatcgtatgaaggatgagacggagctttgcagggccgaaacgcctgtccgcactgtttcggcgcgcgacggcgtttcgccgcttgcgccgcgctacgcgcttttggcttctggggaactgacgcatatcttttcggatacaggcacaagttggctgcgctttggcgattgcgacgcaacgcggcgtccgtccgacccgctgctgaacgggcagggggtgcttgcagcggtaaagctctgtggacagacgctcacagccgcggctgcgccgttttatcaaaacggggttgagcggcgcagcgaatttggtcccgattttgtggcctatcacgccgatcaggacgatattgggctgacgcagcgattttcaatcgatcggacggcgccggttgaacgctgcgaactgatcgtgcgaaaccgcactgcgctcaaggccgtcgcgcaggtgctgatctattttgaacctgtgcttgcgcgcgacagcgattatgccgcgcacccggctttttccaagctgtttgtaacaggggaacgcgatccggccgcagacgcggttgtgttcgtgcggcggcgcagggaaggcggcgagggtccgtgcctctgcgcaggatttgccgggcgggaagcctttgaatgcgggctgcggcgcgaggatatgacgccgtatccagacgggcttgaaaacctgctgcaattcgacgcattgccttttaacggcggcggcgcgacgcccgatggctgctgcgcgctgcgcgcgacgctgacggttccggcacatggcgaacagcgcatcacgcttttgatctcatgtgcggctgcacgtgaggatgcgcttgacgccttggccggcgcacgcgcagaaaagcgcgccgccgcgccggcgccgctggcggacgacacgatggaagccagactggccgcgcggcttttaccatgtctgctgctgcgtacgtccggcggggacagccgcgcgcttttggaaaacacgcgcggacaggacgcattatggtcgatgggaatttcgggcgaccgcccgattgtcctgttcgattggaacgcacaccctgacggcgcgcgtcttgccgcctatacgcgcctgtggaccttgatgcgcatgtatcggcttgactttgacctgtgtgtgttggggacgccttctgttaagacgccggatggcgtgcatgtgctcctgccggaacggttcgatccgtccgcggttcttcttctgcgcgctgcggcatgccatatcgcaggtcaaccggagccgctggcaccgcctgaatgggagcctgcgccagttctgcatacggatcccgcccccattttgcaggcaaaggggcgccttgacgtggtcggcggcgcatatgtaaacgggcgcttttatgtatcgcgtgtgacgccgctgccgttttcgcatattcttgcaaacagaacgttcggatgcctgctcaacgatgcgtcgctcggaaatacctggtggctcaatgcgcatgaatgcaggttaacgccgtggaaaaacgacattgccacaggctgcgacggcgaaaaactatggctgtcggccgatgggatgctgtatgacctgatccgcggagcacgcgcctctttttcaccggaggacgcattatatgaaggatcagccggcagaattttaacggcggtacgtgtctttgtaccggcgcaggggaatgttaaggtgattgatgtatcgcttgaaaatcaaacggatgaggaggcggaggttatctgtgcgtatggtttggaaccggtacttggcgtaacgcgcctgaacgcaaaatacactcagtttgatcaggaacaaggctgcctgctgatgcataatccctatcacatggcgctgccgtgccatgcggctgtgtacgcgccgcatgaatatccgagctatacgaccgaccgcgcggcgtttttggcgggagactggtccgctcgcgagctgctgcccaataacgatccgatcgccggactgattatccgcaaaaagctgccggcgcgccggcgcgccgatatccgtctgatcctgtctgccggcgcaacgcgtgccgaagcggtcgccgaggcgctgcgccagcagtctgcgccggatgtcgggatggaacgaccggttgaaattgcgacgccctgcgcgccgcttgaccggtttatcaatacgtttgcagtacaccagatccgttccggccggctgtttggaagatgcgcgttttatcagtgttccggcgcatacggtttccgcgaccagctgcaggacgcgtgcgcgctgcgtttgacggaaccggcgcttttgcgggagcagattttgcgctgctgcgccgtacaatttgcggaaggagacgtgctgcactggtggcatccgctcccagccgaaacgcgcggtgtccgcacgcgtttttccgacgatctggtctggctgccgtatgcggtctgcgcgtatgtcgaggccaccggggacaagacgcttctcgacgagcaggttccattctgtacaggcggcgcgcttgcgtccggagagcaggagcagtatatgcaggtacaagcttcagagacacgcgcgccggtctttgaacattgtgtccgcgcgctggaaaaggcatataacctcggcgaccgcggcattccaaagattggctgcggcgactggaacgacggcttttccaatgtcggtgcgcgcggagagggacaaagcgtctggcttgcgatgtttttatccattgtctgcggccgtttcgcggcgctttgcgacggccgcgacgcgcagcgggccgatgccctgcgcgcgcacgccgcgctgctgcgccgcaatgtcgacgtatcctgctgggacgggcagtggtatctgcgcgccttttatgacggcggcgcgccgctcggcggccatggaaacgacgaatgctcgatcgacctgctggcgcagagcttctcagtttttgcagggatgccggaccaggcgcgcgtcagcagcgcgcttgatgcggcccttacccgtctggtggacgaccgctgtggaatcatccgcctgtttgatccgcctttcgccgacacaaaacaaaatccgggatatattaaggcgtatccgcgcggcatccgtgaaaacggagggcagtatacgcacgcagccgtctggttcgcgcaggcgatgcttgagtcaggacgaatccgcgatggatggaggctgatcgatctgctcaatccaacggcgcgctgcacggacgctgcgcgcgcgcaggcgttcaagacagaaccgtattatatgccagccgatatctatacaaataaagacgcctatggtcatggaggctggagtatttacacgggcgcggccgcatggtatttgcggaccgtcctggagacgctgcttgggctgcgccccaaagacggcgctctgacgtttgagccgcatgtgccggacgactggacacattttaccgttaagctgcggcgtgaaaacgcggttttatttattgaggtgaaccggaccggtatgcgttcgcttacagtggacggagcgccggcgcagagcgcgccgctcgacggaagggatcatacgattttgttaacgatctgataacgatggaaaaaagatgatgcacagtcaaatttttatgctataataaccgcagagcggttattatactgggttatgcccaacggctcgccgcttacgcggcaaccgccttttgatgggcaattataccataccgcttaattgcccatcaaaaggcggttgccgcgcaagcggcgagccgttgggaataagattggtataataaccgctttgcggttattataccatgtccgcgaagcggcatggtataattgcccatcaaaaggcggttgccgcgcaagcggcgagccgttgggcataagattggtataataaccgctttgcggttattataccattgcttcctaaaatgtttctttaaatttgcagaaaatttagagatttgtgtgataaggtgtttgtattgaaaaaaataggaggccgaatgatgaacggttttttgaaacgtgccgccgcatgtatgctggcggtttctatgcttgcactcagcgcatgctccggcggtatgcagccgggcggcagcagtctgccggatggaagcggcgacggcgtcgccatgggacgttacatagaggaggagtatgcggtgccggatggcgccggttatatatcaggtatgaccaggatggcggacggtacactggagatggtctgcaatctcgatgccggacggatgctcggcccgtggtatctgtttgcctcctccgacaatggggcgcattggacacaaaagcaaactgtctggccggaggagttgaatacagagctttcaaacatgcagtttgcggcttgggataaccagggcggtatgtacctttattattcgacgtttacgcaggaacagctcgacgcgatgatgagcggcgctggttccgatgagacagccgccgcgccggcggaggaagaacaggagcaggcatcctccgaggacgtaccagccgcagacatgcaggatgggcaggaggatgccgttgaaacgcaggagcagcttgcacaggacaatttcctctatattgcaccggacggaactatacgcacgattgactgggaattgcccgcggatgatagcggtgcaggtccgatcggcctgcaagtggcggaaaacggagatctgctgataaactgttatttcagcatcgtccaagtcgaccccgagacaggcgcggtgaaaaaccgttatctggaggaatcattttcacaaaacttctcctatatcagttataaagatacgcttgctgtttcggagggtgggccggaaatcgatctatacgatttgcagacaggagaaaaaaccgggagtatctccgcttccgctgatgtaaacgacgtttcaacgcgcggttcatttatggttgccggagatagcagcgtgacaagggcgatggcgctggatccggacggggaggcgctctggtttgccgataaaacgggcatttaccgccacgtactcggcggttccgtgacagaaaagcttgtcgacggcgaactgtgctcattgaccatgccgtcatattcgatgcataatttgatcgtctgcgacgatggaagcctgcttgcaatgctttatggcgatgcaggggaatggccgctgttccattatacctattccgccgatacgccaaccgttccatcgaccgaactgcgtgtcttttcgctctatgaaaacgcgacggttcgccaggcgatgggcgtgtatcagcgtcaaaatcccgatgtacgcgtcagctacgaggtggcgctcggcgatgacagcgccgtaacggaatcagatgcaatgcgcacgctttccacagagctgttggccggcgaaggtcccgacgttttaatcctggacgggatgccggttgaatcttatattgaaaagggcgtgctgcttgaccttgcgcctgtctatgatgaacgtatcgcatccgggggacttttgaaaaatgtcgcggaaagctaccggcagacagacaaatctctgccggcaatccccgcacgtttcggcgcgccgctgatgctggcggacgacggcgtcaatccaaagaatcttaccgaacttgtcgattggctgatcgcgcgggaaggcacgctggactccagccggatcagcggcgttctgtccaatctcagccccaattctttgctgccggtgttctatccggtttgctcgcctgcatggtacagtgaggatggtacggtgcgcacggaacagctgcgcgcgttcctgtcagaccttaagcgcctgacggatttggaacacgatccggagcagttggaggaaacggacatggtttatatatccagccctgttgacttcaaatgggacggcatcagatgggcttacaacaatctggcggcgtcaattggagaggtgctgtccgtggcggacatcgcttatccggatgcatatatccggcataaaggacaagggcatttgattcctctgccgggtcaggcgcagaatgtctttattccgcgcacggtactcggtgtgaacgcctccggcaaacagcaggatcgcgcgctttcctttgtcgatcttcttttgtcccagcagattcagcagaatgactttggcgatgggatgccggtcaatgcggatgtattctcaatggcgcaggaagacccgtatcagccctatgacgatggaatgtatcttgcaacgtcctacaccgatggcgagaatgtggatgtgactatggagatggcggtgcgttggccgtccgaagcatttatgaaggagacggccgctatgctggagggacttgatacgccgtcgccgtctaacgcggtcattgagcaaatgctgacagacgaaacaaaggattacttcgcaggcaaaaaatcgctcgatgagacggtcggctccctggcgcaaaaactgaacctgtatctttctgaataatgaggatgaatataggcgggatgcgcggccgcgctggggcctgctttatccttccgagcgttctgggcgtatttgtgttcgttattgtcccgtttctcgatgtggtgcgccgctcatttttcggcgcgatgaacggaacgtttgtggggctgcaaaactatgcttcggtgctgcaaaacagggcttttcagctggcggcgggcaatacgcttcggtttatgggagtctgtatgccgctgctgcttgtgctgtcgctgacagttgcgcttgcgctgtacggaaatccacggtgtgccggtgcgtttaaaacgacttttttggtcccaatggcagtaccgatcgcatcggtcgtgctgctgtggcaggcgctgttccatcaaaacggcctgctaaacagcatgcttgaccgactcggtgggcagcccgtcgcctggatggacagcggcgcggcgttctttgtgctggtcggcagctatatctggaaaaacctcggctacaatgtggtgctgtggctggccgggctggcggggatttctccgtctatttatgaagcggccgctgtcgacggcgcgggtgcgtggaccatcttttggcgcatcacgcttccaaatctgctgccctctctgttcaccataacggtgctttcgtttctcaacgccttcaaggtgttccgcgaagcgtaccttgtagcgggcgattacccacatgacagcatgtatctgcttcagcatctttttaacaattggtttcgagagctttccatggataagctggcggccggagcggtgatgacggccggggtcatcctgtttttaatcctgctcctgcgccgtgcatgggaaacggaatagggcggatttcaaaatggggggattttcgtgcgcagactgaaaaagggactgcttttgctctttttgatcatattggcggtcgcggtgtggtttccgctcgcatttttgttgggcgggtcgtttatggggacgcaggaggtgttgcagaagcttggtcctgtgctcggcgatatgaagggcttcgcttcctggagcctgattccgcagtatccgacactgcgtccctatgtggaattgctgcttgattcgccgcagttctttgtaatgttttggaattccgtccgcctgacagccggcgtcctgtttggtcagatgattgtaggtgtgccggctgcatgggggtttgcgcggtatgactttccgggcaaaggcgcgctgttcacgctctatattgttttgatgctgatgccgtttcaagtcacgatggtatcaaactatctggtactcaatcgtttttctctgctggacacgcacatgggaatcattctgcccgccgtgttttccacatttccggtatttattatgtatcgcttttttcgcgggattccgcgttcattgatcgaatccgcccggctggatggagcgagcgagtggcaaatattctggcgcatcggcctgccgctcggctcagccggcgtcatgtcggcgatggttcttagctttctcgagtgctggagtatgatagaacagccgatgacatttttaaaaaaccgttcgctctggccgctttcgctctacctgccggatattgcggccgaccgtgccggactggcgctggctgcgtcggtgacggcgctgattccggcgattctggtgttcctgtatgggcagacctatctggaacagggaatcattgcggctggtgtaaaggaatgaaacgatgaagcttgaagatattctcaattacagtcccgagcgcacggctgttccgctgagaaagcgtgcactgcgctggctggcggcgttccttgcggtcatggctgtgtgcaccgtgctttcacgcgccgctgattctctcacggtcgccgttgtaacgacacagcatccggagtccggcgcggtacagcataccgtcgaaaccgacgggacgcttgaagcccagggggaaatcgctgttttcacgctcgaagggatgcgcgtgcgcagcgtcggcgcccggaccggggagcgcgtggcggccggtgacgtcctgttcacggtcgatccggacgatatcgcgcgcaaactgaccgaacagcagttggagctgcaaaagctccagctttcactcagccagatacagcagaacgcaaagacgcaggccgagcgcgacgcgcttgccgaaatccgtgcgcaggaggattttgacatcgctgcaaagaagctcgacctgcggatcaagcaggcgggagaggaccgccgcagagccaaaaacgcgctgcgcgactataaaaatgaaacggatttcgaggaggaggacgaggatttaaacgactacgacctcgatccaacctatatctctctgcgagacgattatcgggccaaacagcttgcttacgaggaggctgtcgctgaacagcgcgacgagcaggtgaagctggaacgcgcgctcgaggatttgcggctcaaggacgtcgacaatcaggcgcagattcaagcgattgaatgcagcctgaagcagttggagatcgcacgtttgacagaactttcggccgcgggcggcgaggtgacggcgccgtccgacgccgtagtgacctcggttgatgtcaaggctggcggtcaaacggggacgcaggccgctgtgatgcttgccggtcaggaaacagagctgcgttttacagcggaaatcccaaaggaggaacaaaaatatatttcccccggcgacgcggttgtgctgacgctgcccgaccgttcaaaggtggaggcgattgtggaaagcgtcgcagccattgaggaaaaaaacggattgctcaggctgacggcgcttttgccagcgggtgaggggacgcccggcgcgcttgcctcaatgacggcacagaagcgaagctccagttatccaacctgcgtcccggtcgacgccctgcacagcgatgggaaccaggattatgtctatattctgcggaccacagaaaccgtgctgggaacggaacaaaccgtcgaacgcgtcgatgtgaccgtacaggaaaaaaatgagtcgcgcgctgcggtcacaggcgcgctagattccacagacgacgtgattataacaagcaataaaacgatcggcagcggcgaccgtgtacgagtggaggccgctgaatgacggccctgctgcgccgcgcgccctgttgggctgccttggcgctgacaatgatctgctggtctttttcaattacatatgcgcgtgctgctttcgaatgcagcgggcgcgccgtgcttcggctggatggatatgcccttgatgcagcggctgtggaaacgttgtttgacacacaggctcgcctgccgtcggccgtcaggtttgcggtctggcggcaggacgaccggaaaactgtcgaaaatgaggcgttcggtcgatcctgtaccgcctctgttctgctggtacgcggcgacgcgtccctggtgctgccgtccggcgccgtgctttccgacgaggaccgttccggctgtctgatcgaccgggagacagctttgacgctatacggcgatgaaaatccggctggcgcgcagctattatatgatgggcgtgtttatactgtgcgcggtgtgttcgcggccccggctggtacggtcgttttgcgtgcgccgtccttcggcacaatgacgtttgaccgcattacgctcgataccgcggggcagatttccatgcgcgaagccgcgcggcagttcgccgcgcggcacagccttacggatccgctgatcattacgactgaatccatcgcagcctggggcggactgtttatgcgactgccaggtattgtgatgggcggcgcgctgatctgcgcattgcttatgctggcgcatagcaggcacgcctggccggtacagatggcttgttggatatttgcagcggcggcggccctggttttgtatttatggatcatggatgtgcatcccgccgtcccgcaggatttggtaccgaccaggtggtccgattttgaattctgggcgcgtctgtttgaggagcgccgcagggaactgatggaatatatctggatgaaaaaggagcgcccggatatcctggttttgacccggcttgggagttcggctttggctggctgcggcgccctgtttttttggagcggcgcgcgccgctcgccagtggcaggactgggagagctgctttgtacgttggctgtgtgcttactgggcgcctttggcggcgtatgtctcgctggcggcacagcatggatgctttggatttgcgcgccgcttttctttatattccggcgctttctggaaacaacggaaaagggcaggatcgtttgatcccgcccttttccgttttcagttggaacccatgaggttttctgcaaacttgcgcagttcattctccgtcgtaatttttacggcgctctgcttgatcgtctcctggacgtacatcggcaaagaagcgaaatactgctgcatctgcgggtcgttaaaacaatccggcatgcttaccacctccaaacatattttatcctgtctgctggacgttcagtcagagaaatttatccaattgctggcggtgtggatggcaggctttggacaaacgaccgcatttcctgtttggagcggatttgatgtgtgcgttcaatgacagcctgctgctgtgctggcgaaagcgatgcgaaatattccatcgcgttgaggttttcggcgagcgccattcccagtcccattggaatttcgggaccgtttacatagttggtcacggaaaatcacctcaatgattagtataaaccttgtgcgtccgtttaaacgttgcgggaactgttggcgttatccggcataaactgaattatctgactgatgaaagaaggcgaagcaatggatttaagaggcggacgcattacgatcggcgaactgctgtcccggccggatgtgcgggcacgggtacagcgcgcttttccgggtgtattaaacagcccgcttacggcgcgggttagtggacttaccttgaacggcgcgctgcaaatggcagcgcgctatgtgccgcgcgccaggcttgaccaactggtcagagagcttgaatctatgtagagcagagggcggggcatatcagccccgcccaaggcccaagtcttatttgtcacctgcgagcagattttcggcataacgatgcagttcgtccacactatggacgttgtcgctgcgctgctggatcatgccctgtacataatcgggtaaagacataaaataggcttttgcgcggctgtcagcgctgagaagttcattcagaccggtggtattctttttgtgagacatatttatttcctccatattttaaagttccgttttccaaagcccgtgcagattgcaccaggcgtaaacgcaaatggggctgtcgtctctggcgacggcgaactctgtgaccggattctcgtcaaccggcaaggcgcgcaactgccagccacgccgcgttacaaggcaaacccagccgatgctgtgttccgttgtcatgggatggaacacgcttccaacgctgactttgagggtccctccctccatttcgacaacagggacatgcttttcagacgccccgtcggaagtgtttgcattcagatattccatggcttggccgccgcagctaaggctgccgttgccgcagatcagcgcggcgagcacgtcgcctgatttagtggcaaaaaattttggctgattcatcgttttggacctccaatcctgatggatatcaatagtgtttactgcttgcagtggcttatacaaggtatacaaagcatgcagacggaacctttatttggaaaatttgacgttgaatttgttctcaatcctgcaatagatcatatatttttgtgtatagtaactatttttctttccagaaaattgacaaataaaacgaacgtggtataataaccgcagagcagttattataccgaaaattatggccagggcgatgcgcgggcgcggcccgctgccgccccgatggccgattataccatgtccgcgaagcggcatggtataataaccgcagacggttattaaccggggttatgcccaacggctcgccgcttgcgcgacagccgccctgatggcgaatgatactgcccttgtaattacggcatattggttacagcgatcttattatgtttcgtatattttatcaacatagagtaagagacatgtagatggtaagtgatgcattagtgaaggagcgtatgtgatgaacagaaaaacagagaatgcagcgattcaaacaggcgtctgctatatgatcctttctgcacgcagcggcaaggccataaccgcctgtacaaacaatcgaattgaaatgcgcgatgtttccggaaatgacggccaactgtggagctttgaacaggtcggagatgatgtctggcggattgtcagcaagcagaccaaagatgttgtggatgttatcctttccggcagcgaaaacggcgcacagattcacttgtgggaggatgttggggcagataatcaaaagtggattttcgaaccagtcggcgatggtttgtacaagatcgtttccaagctgtcgggacgttgtcttgatgttgtgggcatgtcgatggaggatggagcaggtattcagatttgggactatatgggcggtgacaatcaacagtggaggattgtggatccaactgtaccggctgctgaaaaacctgtgaagaaagcggccgcgccgtccgcaaaaaaatctgctgcaaagacaaccgggaaacccgctgccaaaacgacgaaagcggcgtccaagccggctgctgaaaagtccgcaaagcctgcgaaaacgcagacgaagacgactgcggctaagacagcaaaaacagcggctaaagcggctcagaaggatactccgaaggccggcggcgaaaagaaaggcgaatgaatttaaatccgcggaccaatatatggcccgcggatttttcgatattctgcattaacagtgacgaaggcagcttgtgatggaaggcggcgcttcgaacttgacgaagtgcgtccataacgggtataataaccgaaagcgtctgttatccccgttatggacgggggatacgggcggggcctgcggcggatgatgggcggttgcgccacgcctacaaacggtatggtgcaatcattgcaataaatatgataccccgtgacaggatataaacaggagcggagtttattatgacattaaaacggtatgatgcgattgtcgtcgggagcggctttgcaggagcggtaacggcacgtgaattggccgagcaaagcggcgcacgggtgcttgtattggagcagcggccgcatattggtggaaatgcgtatgattgtttggatgcggcgggagtgcgcattcattgttatggtccgcatatttttcatacaaatgacgaacgtgtttatcgttatctcagccgttttacacagtggctgccatacagccatacggtgcttggaaacatctatggtaagcttgtacccataccatttaatctcaattcaatcgacgcccttttcagtactgaaaaggcaaggcgcctggaacggcgcctcgtggaacaatatggcgctggcagccgtgtttctatccacacattgagacaggccgacgatccggagctttcggatcttgcgtcattcatcttcgaaaatgtatttgcccgctacacagaaaagcagtggggtacgccgccggatgcggttgacccatccgttttgtcgcgtgtgccggtgcttgtttcgcgcgacaaccggtatttccaggatcgctttcaaggaattccgcgggatggctatacggcattgttcgagcgtttgctcgaccatcccggtatagaggtgcgtttaagcatcgacgcgcgttctctgcttgatgtttcatccaccggcgtccggtttgaaggcgcgccatttaatggggtagtcgtctatacaggtgcgcttgatgaactccttggctgttcgcttggacgtttgccgtaccgcacgctggatttccaatttgaaacacttccggtcacttggtatcagccgtgcgctacggtcaactatacggttgatgagccttttacaagaattacggaatttaaatatttttctgcacaaaaaatcgaaaataagactactattgttaaggagtttgcgcgcggctataccggcgacagcggggaaattccctattatgccgtgctttgtgaaaaaagcgcggcgctttacgcctgttatttgaagcaaatcgcacatctgtctcgtttttatcttataggaaggctggcagaatatcaatattataatatggacgcgattgttggacaggcgctttcgcgctcaaagaaaattttacaggatttggagggatccgtttgaagctgataacatttgctgtgccatgctacaattcccaggcgtatatggatcactgtatctcaacgctgttggcttgcggcggcgcagaggatattgagattatccttgtagacgatggctcgacggatgacaccggacacatcgcagatgcatatcgtgaaaaatatccggatattgtccgcgtgattcatcaggagaacggcgggcatggagaaggcgtcaatcagggacttcgaaatgcgtcgggtctgtactataaagttgtcgattcggatgattgggttgatgtggcaagcgttaagcggctgctgacggttatgcacggccacatcagggatggcaaacagattgacctgtacctgtgcaactacgtttatgaacatgaggagcagggaagccgtgcgatgcgctatcgcagcacactgccgcgcaaccgtatttttggatggtcggagacaaaggcgtttaagccgtggcagtatctgctcatgcacacgatggtttatcgcaccgcgctgctgcgcgcctgcaatcttgagctgcccagacatacgttttatgtagacaatctgtttgcatatattccattggcacatgttaagacgctttattatattgatacagatctgtatcgttattatattggccgcgccgaccagtcggtcaacgaagcggtaatgatccgccgtgtcgaccaacagttgcttgtaacgcgattgatgattcaggcgtataaaagtgatgatctgaagcgtctcgaccgcaagcttgcacactacatgtttaactatgtcacgatgatgatgaccatttcaacgattctgttgacactggatggcagtgacgccgcattgcagaagcgtgttgatatctggcggtatctaaaagcggaaaacccggattggtatgcgccgatccgttatgggtctgttgccacatttgtcaatttcccaggtgaatttggccggcgcttaagtattggcaactatcgtttggcccgccgtgtgtataaatttaactgaaagggaccgcttcgcatagatggtcaaaatagtatttggaggcgttgcgatgaaagcaattggagagtttttgtataaataccggcatgcggctctgctgttatatttctttccatatatgatgtggtttggatggcttcagcaaaatacgcgtccagtggtatgggtgtgctcgtggatcgacggttatattccgtttttagaaatatttgtaattccatatctgatctggtttttctatatcgccgcggcgatggcgtattttttgtttcattcgcgcacagagtttttaaagctgtgtactttcctgttcacaggtatgaccatttgtctgttaatctacaccattcttcccaatggtcagtttctgcgtccgcttgtatttaagcgggataatatttttacagatctggtacggacgatttatttgctggatccgtccttcaatgtctgcccgagcatccattgtctcaattcgatcggagttcatattgcgatccgccggtcacagcttggccagcgcagcagcgcgattcgttatggttcgggcgttctgatggttttgatctgcctttccacggtgtttattaaacagcattcgatcatcgatgtggtggccgcaatcattttaagcatccctctttatctgttggcataccgcttcgatcaaatccgtgattattttgtacagcgccgtgcgcgccgtctctcgcgagatcctgcataatcataaacagcgccggcccccttggggccggcgctgtttatgatttaatttatatatcgaacgcgccctatacttcgtaatcggcgacaacacgctcggtgatgactttatggataaattcacgcattttcagatgctccggatgacaatcatacgctttcagagcatccatggaagcaaattcggagtagagcacaagatcaaagcccttcggattgacgttgatgccaacctccagatgaatgattccgtcaataacgccttttaaggattccaaccccttcttaatgcggcgtgcattttcatcgcgggaattaccctcggcgacatcttcaaggttccacataacaatatgcttgatcatatgtaatctcctcttttttttgatgcttcggggcggaatacagaacacgccgcccccggtcagttggctgatattacatactttatcataaacaatcggttagggcaatatccattccgatttcaggaattattctcaaaatcggaatcggagcgaatcccatatttttcaagctttttataaagcgtagaggtggcaattccaagatgacgcgcggcgttttttttcccatttgtgtcaaatccgtatacatgcagcgcgcacaaaattgcccgacgttccgcctgctcaagcgtggggaccgaaccggcgccaaccgcgccggccggacgctcacgcagcgcgtccggtaaggtcgcacaggtcagcacacccgatgaatccatcatattaatcataaactcaattgtattttctaattcccggacatttcccggccatgcatagcggcgaagtgtcttcatcacatcagcgtctacacggcgcacacgcttttggaagcggtcgctgtaccggcggatcatgagcgccgtcagatcgtcgatatcctcgggccgttcacgcagcggcggaatttttaacgggataacattgagccggtagtaaagatcctcacggaatttattttcacggatggcgcgcagcaagtccttgttggttgcagcgatcacgcggatatcgactttaatttggttgttggaaccaatgcgcgtaattgtgcgctcctggagaacgcgcagaagcttggcctgtaaatacagcggcatgtccccaatttcatcgagaaacagcacgccgtggttagccagctcgaatttacccatccgcccgccgggatttgcgccggtgaacgcacccttgacataaccaaacagctcgctttcgaggagcgcttccgggattgcggcgcagttaagcgccacaaacatttcgtccttgcgttcactggccttccaaatggcattggcgaccaattctttaccagtaccgctttcacctgtgatcagcacggttgacatcgactgggcaacctgtataatccgttccttcaagcgcagggtcgctggggagacgccgacgattttgtcgagggattgttcaaatgtgctgctcgtaagctcataaacatcattttgcatctgccctttttcgcggaacaacaggacctgtatggcgtcggctgtaccgacatacatcggatacagctcgcccatgatagaatagctgcgtcccagcagctccatgcggtactccatgattccgtggatgctgtcgcctgttgcacgcagctgaatttgtgcgccgagacagttttcaggaagatgcagattcttgcaggctgcacaattggcgctgcgcacatgcaggtcgtctgttaaaatcagaacacactgatcaatactgtccaggatttgcgtgagcgtgtcggtatagattcgaatcatctgcatctgcgtattttcctgcgcctttttggcgatgaggtcggcaatctgctcgacaaaatggatataactgtcaagtttttcaagtagcatgtcgcgctgatgtgcggtgaaagccatcaatccgatgacgccttccacatggcccgtcagacggatgggggctgcgatctcgattgtttcagtacaggtatgcctgttggcgcaggcgcggcagatttcatcgcgcccgggattgtggacgacgatagaccgcgcgtcttcaaggacacgctcataaatactcgcccggctgcgcatgctttcgccggtgcgcggggcataaaatccggaacccgcgacacggatatagtcgcggtccataatatcgacgttgacgcccgtgacttctgaaatgacatctgcaaattcgattacagtattctggattgctagcagtgcgctgggagccatggtcaggacctcctgccggccagttcttaaaatcggaattttctggatggtttcatgatactccaaaaagaagatttcgtcaactagaagcaaaaaactgggaaaataggcgagcgcgttttaataaaataaggaaatgtagggcggcagagaaaaactttattgttttttgtataaatcaagatatttggcatggattttgctgtataataaggcagtacctcaaaagcaaaatttttcggaaggagtgaagctatggaccaaaaagtatatgatacatatgtatcgattctgaaaagcgagctggtgccggcgctcggctgtacggaaccgatcgcgattgcgtacgcgtccgccaaggcgcgtgacgtgcttggtgaaatgcccgagcggctggagctgtggtgcagcggaaacatcatcaaaaatgtcaagggtgttgtcgtgcccaattcaggcggcctgcacggcattgatgtcgcgggtatccttggactggtcggcggaaatcctaataaggagctggaagtgctcgaatcggtcacacaggcggatatcgaccgtacaaaagagcttttgcaggaggatttctgctcgtgtcatctgatcgaaaatgtggagaacctgtttatcgtagcaaaggtttttaaaggtgaacacagcgccgaggtggagattgcaaaccgccatacgaacattacgcgcattgtgaaggacggcgaggaatgggatgtcggaaagcatgtggagcttgcgccgcatcaggctgttaagcttgataaatcgctgcttaacgtcaaggatatcctcgaatttgcagattgcgtcaaaattgacgatgtccgcgaggtgctcgaccgccagatcgagatgaacagcgcgatttcaaaggaagggctttccggcgattatggcgcggaggttggcaaaacgctgctcaagtattatggaagcgacgtcaaaatccgcgcgcgcgccgctgctgcggcggggagcgacgcgcgcatgggcggctgttcgctcccggtcgtcatcaattccggaagcggcaatcagggcatgacggtttcgctgccggtgattgaatatgccaaggagcttggcgtttcgcgtgaaaagctttacagggcgctggtagtcagcaatctgatttcgatccatcagaaaaagtatatcggcagcctgtcggcgtactgcggcgcggtcagcgcggcctgtggaagcggcgcggcaatcacatatttgtatggcggcgatctggacgatgtgtcgatgacaattaccaatacaatcgcgaatgtcgggggaattgtctgcgatggcgccaagtcatcgtgcgcggcaaagattgcgtcggcggtggacgcggcggtgatggcacattgcatgacagaaaactccaagacattccgcgctggcgaagggcttgtcaaggatgatgtcgaaggcacgatcgaaagccttggcagggttggccgtgaaggaatgaaggccacagatattgaaatcctgaatattatgattgaaaaataaatgcaccggacagctttgatgtggtggcttttgagggaagggccggcgtattgcgatgtgtgccgcagaagccggtcagagtccagctatgaagctgaaaaagaggaggacttgatatgggtaatgcgttcttgcagaatttcctgatgatcagcgatgtgaaaacaatcttatttttgattgtgctggcggcgctgttctacctgattcatgtgctgtaccggaaaaagcatatggattttgccgcggttgttatgatcggaaccggcatcggtctggtgcttggccttgtcatccaggtggtcgccggatttccggacaatccgatggaggttacgtttgtcagcgagacaacgacctggtattcgctgtttggcaacggctttatcgacctgatcaagatgctggtcgtgccgcttgttatggtgtcgatcacacaggttatcattaacatgcaggaaggccgcaatatgggccggcttgtaaaagtgaccatcatcaccacaatgactatggttgccatcgccgcggtcgtcggcgtggtgctcgggatggtttttaatatcggcgccggcggcgttgcggagggcaccgctgaaattaaagaggtttcatccatcgtttccacgctgcgcggtctgattccggcgaatattgtcaccggcatggtaaacagcaatatcatcggactggtgattttctccgctgtcttcggttatgcggcctggtgggtcggcaaggaatttccgcagttcggcgagccgatgttcaatgtgatcaacggctttcacaagacgatgatcaacatggcgaatttaatccttgattatatgccgtttgctgtgatggcgctcctggccaacaccattgcgcagagaggcgtcgcgagcattatcgaggttggaaaatttatcatcgtgctgtatctggcggttgcaattcaatttgtgattcagctggccgcgctggcggttcatggcatcaatccggtattctatctgaaaaaatcggttgagtgcatgctgctggcctttacatcccgctccagcgtcggctgcctgcccatgacaatcgaaacgcttaacaagcgtctcggcgtcgatgagggtactgccagctttgtggccggtttcggcacgaccgccggtatgcagggctgtgccggcgtgttcccgtcgctgcttattatctatgttgccaacgtcaccggcacgccaattgatgtgacgctgattgttatgacgattattgttgttacaattggttctctcggcatcgccggtatcccgggcaccgcgaccatggccgcctcggtcggcctgtccggcgtcggaatggcctcctcgttcgcgatggtcagcccgatccttgcgattgatccgctgatcgacatgggccgtacctggctgaatgttaccggatcgattgtcaacgctctgatcgttgacaaacgtgtaggtacctttgacgcaaaggcttatcaggatatgagcatcaagcaggtaaaatcgaagtccaagggctgaataacaggcagcctgacaatcaatctaaacaggaaagaggaatccgtatgcattgtgaatacacacctgagggcgtctgcccgtcgaagcttgaatttgatctcgacggcgacgttgtgaccaacatcaaatttacagacggctgcgacggcaatctcaaggcgcttagtgctgtcgtgaatggaatgactgtttcgcagatcgaacagtatttcagcaatatcacctgcggcagcaacacgacctcctgctcgatgcagcttgcgcatgccgtgcgtgaaaagtacaatgaactgaatgcgtaaacaataaaataaagaagcgccggacagcactgtccggcgcttctttatgtggaaaatatacgtagcttttgaaggttatccgtgctataatatatcattacggctttgagtttatggagggaggaagaagattgaaccggcaaattaaaacaagtacgcttttgcggcgttttgctccatattttaaaaagtacagaggggtgctggcgcttgatttgttctgcgcgtctctgacgacggtctgcgagctggtgctgccgctgatggtgcgctttatcacggaacgcggcatgaacgatatggcaagcctgactgtcgcgcttgtgctgaaaatcggggggctttatctggtgctgcgtatcatcgacgcggcggccaactactacatgcagaatatcgggcatgtgatgggcgcttatatcgaaacagatatgcgccgcgatttgtttgagcatttgcagaagctgccgttttcctattatgaccatacaaagattggccagctgatggcgcgtattacaagcgacctgttcgatgtgacggagttcgcgcaccactgtccggaggaatattttatcgcggcgctgaaaatcgttgtgtcatttgtaattttggcgaatacaaaccttctcctcacgctgatcatcttttctctgctgccggttatgctcctgtgtacaatgtatttcaatacgcgtatgcgccgcgcgtttaaaaaatcgcgcaaccagatcggcgagctgaacgcgcaggtcgaggacagcctgcttggcgtgcgcgtcgtcaaatccttcgcaaacgaatccattgaggaggaaaaattcagccagggcaacgggcggttccttgatatcaaaaaggagcagtatttttatatggccggctttaacagcatgacgcgtatttttgacggcctgatgtacgtggcggtgcttgttgcgggcgcgctgttcatgatcgccggcaggattacagccggcgatttgatggcgtatcttctgtatgtgacggcgctgcttacatctatccggcgcattgtcgagtttactgagcaattccagcgcggcatgaccgggattgaacgctttatcgaggtcattgacgcgccggtcgatatcaaaaacgcgccggcggcgctgccgcttggagatgtccatggcgatatcgcttttgagcatgttagttttcattattcggacgacgagcattgcgtgctttccgatatcaatctgcatgtacatcctggcgacagcgtggcgctggtcggtccgtccggcggcggtaaatcgacgctttgcaatctgatcccacggttttatgacgttacggcgggccgtattctgatcgatgggaaggatatccgcaacctgacgctcgattcgctgcggcgcaatgtaggcgttgtgcagcaggacgtctacctgtttgcgggcagtgtttatgagaacattgcatatggccgtcccggcgcaacgcgcgaggaggttgccgaggcggcgcgtttggccggcgcgcatgatttcattatggagtttccggacgggtacgacacctatgtcggggagcgcggggcgcgcctgtccggcggacagaagcagcgcatcagcattgcgcgcgtatttttgaaaaaccctccgatcctgattctcgatgaagcgacctccgcgcttgacaatgagagcgaacgcattgtacagcagtcgcttgagcagcttgcccgcggacggacgacctttacaattgcgcaccgcctgacgacgatccgcggcgcgcagctgatccttgtcctgaccgaggacggcatcgcggagcaggggacacatgccgaattgatggaaaagggcggcctgtatcatcgtctgtacagcatgtacacagagatgtagacgggaggaatatggatggtcagggatatgacggtcggaagcccgtcaaaaatcatcataggatttgcgctgccgatgatctttggaaatatctttcagcagatgtataatatcgtcgactctgttgtggtcggcaactttgtcggtcccgacgcgcttgccgcggtcggagctgcatatccgtttaccttcctgttcatcgcatttgcaacgggcgcgtctatcggctgttcggttgtgatttcgcagttttatggcgcgggacgctgcctggaaatgaaatcctctgtattcacagctttgacgtcgatggcggcggcaagcgtgctgctcatggcggttggcctgccgctttgcgggcctgtgctgcgtctgatggatacgcccgcggatatctatgccgatgcgtgcggttatctgcggatttatgtgttaagcgttttgttcatgtttttgtacaacaccgcgacagcggcgtttaacgcccttggagacagccgcacgccgctttatttgcttgcgttttcttcggcgctaaacatcggactcgatttagcgtttgtaatccgctgcgcgatgggcgtgacaggcgtcgcctgggcgacgctgatcgcccaggcggcggcttcggttttggcgctggccattttaatgcgccgcctgtatgcgattaagtgcaaagggcgcccgcgcttatttgaggcggcgcgtttgcggcatatctgccggattgccgtgccgtcggttgtccagcaatcgattgtatcgatgggctttttgttcgtacaggcgcttgtcaaccgctatggaccggctgtcatcgccggctatacggccgcgactaaaattgacagcatcgccattatgccgatgctcaacgtcggaaatgccgtctcatcgtttacggcacagaacatcggcgcaaggaaaaccggaacgcgcccggcgggggcttggcgccgccattttgctgaccgtggcgatcggcggactgacggcgcttgtgctgtgcttgtttggcgcgcagtttgtcgggttgttcgttgatacggcctccaatgaaaaggtgattcaggcgggggttggatatctgacggtcgtgtctgtgttttatacagcgatgggaattatgagcgattttaacggagtcttgcgcggcgcgggcgatatgcgcgtctttatggcaagcacgctgatgaattttttcacacgcgtgacggcggcctatcttctggcggctgtgatgggtgaagccgcaatctggtggtcaatcccgatgggctggaccgttggactgctgatctccggagcgcggttttttaccggcggttggaaaaataaatcaattgtgaaggatgcgccggcataggggcgtccggcttttgcagacggtcctgaggctggcgggggagataaagttcatgacaggaaaaagcgcggcgcgcgcccagcgcgctgaaatccgttcggaatatttcagatacctggtcccgacaatcatcgggcaggtagcgcattgctgctattgcctggccgatgttttttttgtcggtcttggcgtcggcaaggatggtttggcggcgctcaatgttgcgctgccgatatttacggtttacacaaccttttcgatcatgatcggcgtgggcgctgcgacaacgatctccgtatgccggggccgcggcgaggatgagaatgtcgaccgcgtatttacgacggcggttgcgacggtactgattgtgggggcgctgctgtccgtttttggaacgctttttctgcgcgaggtagcctatttgttcggcgcgaccgatttaatcgtcgatcacgtggtcggatacttggccccgatcagtccgttcagtttcatctatatgctttctagcgccatgtgcgtcattgtgcgcagcgacggaaacccgcgccttgtgatggttgccgccactacgggaaacatattgaacattgtgctcgattatgtatttgtgctgccgctcggaatggggacgttcggcgccggccttgcgacaattattgggccggttgtaacgtgcctgctgctgagcctgcattttttgcggcattataatcaggtccatttcacccggcgctttttttcgccgcgtctttttgcccgtatggtgcgcaatggggccggttccggcgtgctggaaacatcgtccggtttcgtgattttgatgttcaatctcacgctgctgcgtgtcagcggtgaaacagccgtcgctattttttcaatcatttccaacattggttatgtcggcaagggtattttcaacggcatggcgcaggccgcgcagccaatcatcagcatcagttatggcagcggcacatatagccgcatgaagacggtcaatcgttttgccatgcttacggcgctcggcttttctctggcggtgtttgggctgattgtactctttcccgggcagatcattacactgtttatttcaagcgacgcgcagattatagccatgggcgcgcctgccgttgtcctgtactttttgtccttgccgtttaccggacttaacaccatattgatgtactatttccaatccaccgagcatgcgcgtatcacggcgctggtcgccgtattgcgcggtattgtgctggtatacgccgcgctgcggattttttcgtctctgtggggactcacaggcgtatggctggcgctgttcgccgcggaggggcttacgttccttgctttttatccggtcaaactgcgcctggatgcgcgtatgcaagacggcaaatagtatgacaagtggtattagtttacaaaatcgggtgcagacgccaacgcattttaaaagatgtctccaatcttttaaaatccttttattttcaattgaaaagcgattggatttcatgtaaactggaagtatcttttttgcgggaggtcggcgggatgcggtgttttcagatttgcggacagaaaaatcggagcacacgcgccgccagtttggcagcccatcgacatccacagggtttttgcaggttgcgaatcaatcgcagcctgttttcatttacagaaaatggcggtttccgccgatggaaagggacgatctgattatggctgagaaaaaagttgcggtcgtaatgggcagcgacagcgatctgggcgtggtgcgcgccgcgatcgatacgcttaaaagctttgggatcggcgtgcaggcgcgcgtgatcagcgcgcatcgaacgccgcaggaggccgctgccttcgcatcaggcgcgcgtgaaaacggtttttcggtcatcattgccgccgcgggcaaggcggcccacctggccggcgtgctcgccgcgcatacgacgctgccggtgatcggcatcccgatcaaatcgtcggcgctcgacgggctggacgcgctgctggcaaccgtgcagatgccgggcggcatccccgttgcgacggtcgcgatcgacggcgcccagaacgcggcgattttggccgcgcagatcatcggcatcacggatgctgagatcgcctacaagctgtccgtgcgccgcgaggagatgcgccgcaaggtggcggaaaaggacgagaagctgcgtgaacagctctgctgacaggcgggcttgaaaggaaaatatgaaaggcacagtggaggtaaaaatggaaaagctcgaacagctctatgagggcaaggcaaaaaaggtttttaaaacggacgatcccgaggcatatatcgtttcctacaaggacgacgccacagctttcaacgggcagaaaaaggggaccattgccgaaaagggcgtaatcaataaccgtgtttccaaccacctgatgcgtatgctggagaaagaaggcgtccccacgcacctgatcagggagctgtcagaccgcgagacgcttgtcaaaaaggtgacgattgtaccgcttgaggtgattgtgcgcaacatcgcggctggttcgctctccaagcgcctcggcctgccggaaggcacaaagctcaaaaagacggtgctggaatacagctacaaggacgacgagcttggcgacccgatgatcaacgactaccatgtgttcgccctggggctggccacgccggaggagctttccgcgattgccggttacgctctgcgtatcaacgagctgctgtctgcgtatcttaaggatctcaatatcgagctgatcgattttaaactcgaatttggaaaaacctcagacgggacaatcattctcgctgatgagatttcacccgatacctgccgtttttgggacagcaggaccggcgaaaagctggacaaggatcgtttccgccgcgatatgggcggcgtcgagggcgcttatcacgaggtgatgcgccgtctgctcggggaataagcgcgggaggaatgcatgttgctgaatggattgcatgaggagtgcggcgtttttggaatctatgagaaggagcgcgccgatgtggcgacgagcgcctacttcgcgctgtatgccttgcagcaccgcggccaggaaagctgcgggatcgctgtcaacgacgacggcgtcatcaattgccacagggatgtcggattggttcccgaggtgttcagccgggaggcgctcgaccgccttggctgcggcaatatggcggttggccactgccgctactccaccaccggaaacgtaagcgccatcaacgcgcagccgctcgttgtgcgccactgtaagggcgcgatggcgctcgcgcacaatgggaatcttgtcaatgcgctcgaactgcgccggcagcttgaaaacaacggctcgattttccatacgacgaacgacagcgaggttatcagctatatcattacgcgcgagcgccttttgtcgccgagcatcgaggaggcggtcgctaaggcgatgtatacgatcaagggcgcgtattcgcttgtgattatgtcgccgaaaaagctgattgccgcgcgcgatccgaacgggtttcggccgctgtgcatcggcgcgacaaaaaccggctttgtgtttgcctccgagagctgcgcgctcgacagcattggcgcgcgttttttgcgcgacgtggaaccgggtgagattgttgtcgccgatgaggacgggctgcgcagcatccgtacccactgcggcggcaggagcagcttctgcgtattcgaatacgtctattttgcgcggcccgattcggttgtaaacggcgtgagcgtccatgaggcgcgccagcgcgccgggcgcatcctgtaccgcgagcatccggttgaggcggatgttgtaatcggcgttccggacagcgggcttgacgcggcgctcggtttttcgcgggaatccggtattccatacggcgtcggctttatcaagaaccgctatgtcgggcgcacctttattcagccgacgcagggccagcgcgaggacgccgtgcgtatcaagctcaatgtgattaatgagacagtatgcggcaagcgggttgtgctgatcgacgattccatcgtgcgcggaacaacctgtggacgcatcgtaaagctgctgcgcgaggctggcgcgaaggaggtccatttcatggtatcgtcgcctccgttccgcaatccgtgctatttcggcacagatatcgacagccgcgacaagctgattgcctgccggatgacgatccccgagatcgcaaaatcgatcgacgtcgattcgctgcattatttgagcgtcgacggcgttcgggcgatcgccgagggcgcgaactgcggtttttgcgtcggatgttttacaggcgaatatccggtcgatgtgccgggggagctgccgaaggacaaattcgaatgtaaaatcagcgacagggacaaacggggtgtcagatgatggaaaacagttattcggaatcgtataaggccgccggcgtggatgtgacggcggggtatcgggcggtcgagctgatgaaggcgcatgtggcgcgcacagtgaccaagggcgcgctcggcggcctgggcggctttggcggcctgtttgagctggatttatccgatatgccgcatccggtgctctgcgcggggacggacggggtcggcaccaagctgaaaattgcctttttgctggataagcacgatacggtcggtatcgactgcgtggccatgtgcgtcaacgatattatctgctgcggggcaaagccgcttctgtttcttgattatattgcgtgcggcaagaatgtaccggaaaagatcgcttcgatcgtggcgggcgttgcggagggctgcgtgcaggccggctgcgtcttaaacggcggcgagacggccgagatgcccggcttttacgcagcggacgaatacgatctggcgggctttgccgtcggcgcggtcgatcgcgcgcgcatcctcgatcactcctgcgtcgcgcccggggacgcgatcgttggaatcgcttcaagcggcgtccattcaaacggtttttcacttgtgcgccgcgtgtttgatgtggagcgccccggcgttttgcagcagcggtatgacgatctgggcatgacgctcggcgaggcgctgcttgcgccgacgcgcatttatgtaaagtctgtgcttgctgttatgaaggcgctggccgtcaagtcggtcgcgcacatcaccggcggcggattttatgagaatatccctcgttcgctgcccgaaggcaggcgcgcggtgatctgcaagcgcgtcgtcgaccgccacccgctgtttgaactgatccagaaagcgggggatatccctgaacgcgatatgtacaacacttttaatatgggtgtgggcatgacgctgattgtcggaaaggacgatgcacagcgcgctgtttcgattttggctgaaaatggagagaatgccaaggtgatcggctatatcgacgacggcgaaaggggcgttgagctgtgttaaagcgcatcgtcgttctggtgtccggcggcgggtctaatttgcaggcattgattgacgcgcagcacagcggcgtgctcaaaagcggtgcgattgtgcgcgtcatcagttcgaaagcggatgcgttcgcgttaacgcgcgcggcgcgcgccgggattgaaacgcaggtgctttgcccaaacgattatgatacgcgcgcagcgtttgacacggcgctgcttgcggcgctcgccgatgcgcgcgccgatcttgtggtgctggcgggatttttgtatgtcctggggccgcaggtcgttaaggcgtatccgcggcgcatcatcaatgtgcatccgtcgctgatcccatcgttttgcggcgacggcttttatgggctgcgcgtgcaccgggccgcgcttgattacggcgtcaaggtgacgggcgcgacggttcactttgtcaatgaaattacggacggcggacagattattctgcaaaaagcggtcgacgttcttgaaggcgacacgccggaaatactgcaaaagcgcgtaatggagcaggccgaatgggtgctgctgccacaggcggccgagctggtctgccaggacgcggtggaggagcgataaaatggagcttttaaaactggagcgtctgctgcgggaaaatccatatccgggccgcggcattgttcttggacgcagcgcggacggacgatacgccgttgcggcatattttatcatggggcgcagcgaaaacagccgcaaccgcgtgtttgtcgcggacggcgagggactccgcacagaggcgtatgatcctgcgaagttaagcgacccgtcgctgatcatctatgcgccggtacgcgtgctgggcggcgacaccatcgttacaaacggcgatcagaccgatacgatttacagcttcctttccggcggcaaatcgtttgcggacgcgctgcgcacgcgcacctttgagccggacaagccgaactttacgccgcgtatctcggggctgctgcacggtttcgactaccgcctgtcgattctcaaaagcgcggacggcaatccggattcgacgcggcggtatttctaccaatatgaaaatccggtcgcgggcgagggccattttctgcacacatatcgcggcgacggaaatccgctgccgtcctttgacggcgagccggagcgcgtcgcgattgaaggcggcataggcacgttcacagattgcctgtgggacagcctgaacgacgaaaacaaggtgtcgctttttgtgcggtatatcgatgtcgcggcaggaaggcacgagacgcgcatcgtcaacaaaaacaaataggaggaacgcggttatgcctggggaactggaattgaaatatggctgtaatcccaaccagaagccggcgcgcatctttatgcagcagggggagcttcctgttgaggtgctcaatggaaagcccggcttcatcaactttctcgacgcgctcaatagctggcagcttgtgcgcgagctgaaggccgcgacgggacttgcggcagcggcgtcctttaagcatgtcagcccggcgggcgcggcggtgggcctgccgctttccgaggttgaaaagaagatttactttgtcgatgatctgacgctttcgcctgtcgcatgcgcttacgcgcgcgcgcgcggcgcggaccgcatgtcgtcctatggcgactgggcggccctctccgacgtttgtgacgcagagacggcgcgtctgctagcgcgtgaggtttccgacggcatcatcgcgcccggctatacggacgaggcgcttgaaatcctcaaaggcaagcgccgcggcggctataatattgtaaggatcgatccggattatgtccccgcgcccgtggagcataaggatgtgttcggcgtgacgtttgagcaggggcgcaacgagcttgtaatcgacaggactctgcttgaaaacgtcgtaacagcgcacaaggaaattccggatgatgcgaagcgcgatcttctgattgcattgattacgctcaaatatacgcagtctaactccgtctgttatgcgaaaaacggccaggcgatcggcgtcggcgccgggcagcagagccgtgtgcactgcacgcggctggccggtcagaaggctgacaactggtggctgcgccagcacgaacgcgtgcttgcgctcccgtttaaacccgatatccgccgcccggaccgcgataatacgatcgatgtatatatctctgacgacagcgacgatgtgctggcggacggcgcgtggcagaatttcttcaccgagcggccggcgccgctcacgcgcgaggaaaaacgcgcctggctcgaccggctcgacggcgtttcgctcggttccgacgcgtttttcccctttggtgacaacatcgaacgcgcgcgccgttccggcgtgtgttacatcgcgcagccgggcggttcgatccgcgacgacaatgtgatcgagacatgcgacaaatatggcattgcgatggcgtttacaggcatccgtttgttccatcattgacgggaggggttgcgatgaaaattctggtggtcggcggcggcggccgcgaacatgcgctgatccgcaagctgcgtgaaaaccccacagtgacggaggtctactgcgcgcccggcaatgggggcattgcggccgacgccgtctgtgtgccggtcaaggcgacggacatcgaagggatggttgcgctggcgaaggaacgcggcgtcgatttttgcgtcgtcacgccggacgatccgcttgtgctcggcatggttgacgcgatgaacaaagccgggatcgcaaccttcggaccgaaccgggcggcggcgcggattgaaggcagcaaggtgtttgcaaagaacctgatgaaaaagtacggtatcccgacggcagattaccatacgtttacaaatccgtccgaggcgcttgggttcgttaccggtaaaaatgaattcccaattgtcattaaagctgacggattggcgctgggcaagggcgttgtcattgcaaatacgcttgatgaagccgccggggcgatccattccatcatggaggataaaaaattcggcgcctccggaaaccagattgtcatcgaggaatttttgactggcccggaggtcagcgttttggcgttctgcgacggcgagacggtcgtgcccatgatttcttccatggaccataagcgggcgtatgacggcgatcagggcccgaataccggcggcatggggacagtcgcgccgaacctctgttatacgccgcagatcgcgcagcaatgcatggaaacaatcttccggccaaccgtcgacgcaatgaaggcggagggatgcccgttctccggctgcctttatttcgggctgatgctcacgccgaaaggtcctgctgtgatcgaatataactgtcgtttcggcgatccggaggcacaggtcgttctgccgcttttaaagacggacctttttgatgtgatgcaggcggtctgggaaaaacgccttgggcagattgaagtccaattctccgatgagagcgcggcctgcgttgtattggccagcggcggctatcccgcgggatatgagacgggctttgtcatcgatgggctttgcgaaaacggccaaatcgagggtgcggccgtctatcatgcgggaacaaagcgtgaggacggcgtttataaaacggccggcggccgtgtgctcggcgtgacctgcgtcgcgccggatcatgtatctgcgattgagggcgcataccgcgctgcggaaaaaattcattttgatgggatgcatatgcgccgtgatatcggcgcgcgcaatcgaatataaacgattgaaaaaatccggccggacaatgcccggccggatttttaaaaatggaggacggatgacgcgtacattcgttttcgcataaactggtgtgaggaggtgacgcacaatggcggaaacaggagcgcctggcgtcgtcgccgcggccgggtcaaccggcgaaatcgcccaggaaacccaaaagaccgctgtaaacaacccgcaaaatgcaggcggtctggcaaacccgcaggcgatgagcgggcagggcgcgcagtttgtttttgtcgcggcaacgatcgcaaatgtgctgtgcgacaacctgacacaaatgcagatcaacctgctggcaaactttttatcggttattaccacctgcgtatatgcgatcctgacagttgaaaatccaacggatatcatcgaagcctgatgcgccggccggcgggcgaaagcccgcttaccggcgcaactttgtgtttttaaatgttgccgcccggcgcatacagatacaaaatcgccgatggacggccgaaggccagtccggaccatggattattttgtagtggaaaaccggcgaaaaatatgatatactgatagaacatctcggacgccgcccgcgtacagaggcggtttgcgtgaaatattttcagacggatgcagtaaaatgcaggaatttgatcactgtatcaatgagccgtttgatgaaaatggtgggttagaacatggttgtggatgttgctgccgtcgaaaaggcgcggcgcggagataaggacagtttcgcggaggtctaccggcagattgccgatgacctttaccgtgttgcgctctattctctcggcaattcccatgatgcgcaggatgttgtcagtgaaacatttattgaggcgtataagggtatcgcaaaccttcgcgacgaaaacagcttcaagccatggattatgcggattctttccatccgctgcaagcgtaaaatcggccagtatatatcgggacgcaatgaattggacattgacgattttctcgatctttccgaggaaggggagggcgtcgagacgcgttctacacaaaaaatggcgctgctttctgcattggagacgctttcaccgcaggaacgccagattgtggcgttggctgtcgtacagggatatacggtgcgtgagacggccgaaattctcggcgcgccgcaggggacagtcagctccaagctgcatcggaccctgaaaaagctgcgtgcgcagttggagaaataatgattgggaagggagtgaatgagccatgaattctgatatgcacagagagcttcaggaatcgatcgatttgctgcgcggccagtttgatgaactgagcagcggcattcgccttccgcattcgctcgacgcggacgtgctgcgtgaaaagttaaatcatgtggttccctttcccacatccacgccccgaaaacaccgttggcgggcgggagtgagcattgcggcctgtttcgttttggtgttgggcgcgggtgtgatgctgtcaagacagggcggagacgtcttgtcgcgctcggccgcgccgcaaagcgccggtgcggcggctcccacggcagaggccgccttgtttgatgcgtccgtgccggcggctgacgcgggaattgcgggatattccgcattgccggaagatctggaggagggtatggacgcagcggctccaaaagctgcgccggcctcagaggaggcccctcttttggcggcagggccgacagaatttaccgatgaagctgctgatgcgcctgctgtgggcgccggccgcgctgcggagtttgttgaccgcgatacattgacaggcgatttccttccgctgccggagctttccgatgcgcgtgcggttcagacctatggcgcttatgtgccggtgcaagcgccggttgggacggtttattccgatggaaccgaaagtgagagcggcgtctccgttttgttttcacagccgggcggcagtaaggagctgcaactgagcgtcactgttctgaccgaggcggagcggacgtatgtggtcgataccttacggccggagacatatgaccttcgtctttattccaagccatatgccgattcaatccctgaaaatctgactgaaatttgcagaaacgctactttttcggcggaggatgtaactgaacagattttacaggcgcgtctggtgccaagcagcgaatcgggcggcgaaaaggcttattacggccacattggcgttttatatggagcggatatacttgtccgctataatgcagtcgatctttcaccacaggaattatacagtattattgatacaacgagaaaagccgcggagtgacttgctttgcggcttttcttttgggaggggattgcgtgcggattctggtcgatgcggatgcctgccctgttaaagccgtgattacgcgccttgcaaagcagtataaaattgctgtggtgatggtgctggattcgagccatatattcagcgatggctacagccaggtaatcactgttgatacaggacgcgacagcgcggattattatttggccaacctcatgcgtgccggcgatatcgttgtgacacaggattacggcgttgccgcaatggcgcttggcagaggggcgcgcgcgattaatcaggacggcctgatctatggcgctgataatatggatcgcttattgtttgaacgccacctcgggcagaaggtacggcgcgccggcgggcgtacacgcggcgtcaaaaaaaggacggcggaaatggatatgcgattcgagaaggcgctgaaagagatgctgcaaaataatcaggagggaatggataaatgaagcggcttatcacaaccatgttgacggcctgcctgctgtgcacctgcgcaccgcgcaccgctgcgccgcaggacatggatacaggtctggagcggtccgccatgccagatcggcttgccgcttcatccccggctgtttcttcagcggttatgccggacgagacacttatgacacaaacgcctcaaacggactggatcgaggcggcttcgccagatgggacggtacgaacgcgtttacgcctgcgcgagccgtcagagcggccgtttgcagtgtcgtccgtggtatggaatgaagaaaaggaacaattcgcagcgatctataattgttcggcgtaccggggcgaatatccatggcaaacatatcgtgaggacgcctgggtagaggtacagacgtttgatcggaatggaatgcctttgcgccagatcaggacaaatgttttgcctatgaccgattccattgagggagaggtgctcgattatgcgccgtgcgcttatcagggggactggatttcttttcatgcgggcgagtcatggcctgcctatacatttgtcaacgatgaaacaggagaggtgcggtcggagccggcacagcgtgtctgcatggatggggagctgttcgcgctgtacggctatgtgccggaacgcgccgttcggcttgtgagcgaaggggaggtcctgaaaacggtttttctgcctgagcttggcacaggatttggagtacagttggaccatgctgcacgcgacggcagcgacccggttgcttttgtactggacgcgcaggcgcagagcgcccgcatatctgcggggccgtcgtctgttttgatcgactttgaagcggaaagcgccagcctggagcgccagtatacgcatgaacagcttgaggaacagcttgcgcagagtgcggacggccggaaaatcttatggagcgcgcaaaccggcggtatgggggacggtttttggagcgagctggtgcttgaagatgctgccaccggaacactgacgtatttaagcgatgaagatgggccggcgattccggtatttggtcccggccatttgtttttgatcaatcggatcggtagcatgacaatttatgatgccgatacagccgcgccggccgcagagcagcttgcgtttgattatggagataggcctgatgaacccgattggtttacacttggctgcgcatgggatacggacaatcagagatggatggtggcctaccgcgcaggcggttggggtgaaagcggttcgattgatgaacaaacgcctcttttgatcgacgtgtttgatgcgcagggacagaagctgcgcacagtggaaacaggggtaaaaattccattttcccataagaattatgcggtgaccgtccaattgtttccagaaggggacagtgtcagaatatatgagccgatctccgggctttcgagtgttgccgctttggagctatcttgaattttagaaataaaaaactagaattaaaaatttgggaataaaataatataatataagcatgaataattaatttttaaaggaggaagaaaaattaaatatggaagatacaaaaacatgtaaatattgctgtaccgaacaggaatgtcatatgatgaagtatgtgaaattattggttccgctggcactttaagcagcagtgtaagttcaaacggaatcagtatttcaatttatacttggtatgggggtggaatggctggagcaaacgcaaatgttacatttacaaatgattctgtaacaggaaaagcacaagttggattaaaataaaaaatcccctgtcagtgttgcaacatcgacgggacgacgggtggaaagcatcatgcgcaccggtcttgcggcggcatttaatgcgccgctggccagcgccggagattgcatcgggattaaggtgcggcagctctggagctgctgctcataatttcaaaaaattgcttgacagattgtgcaggtttgctataataaagaaaaccaatcgtggtttaaggggaatcgcaatgaaccgttccatcaataaacagaatcgattttacagcttccagagccagggctatttctttagcgccggctttttttgctgtgaaaatcggattgtgtttgatgagtaatgcggtcgttttgcggcctttgtaagcagaaatgcaagagaactcattgacgcaatgggttctctttttttattgcagaaaataggacccgctgcgatcttaatcagggaggaaacagatatgattgttattatgaaacgcggcacgccgcaaaaggagattgacagccttaccgatgcgctgactgcgaagggggttgaagtcaatcctgtcatcggcaaggatttgattattcttggccttgtcggagatacgagcaagattgacgatacctggatcgaggccaatcgcagcgtcgagcgtgtgatgcatgtggccgagccgttcaaaaaggccaataggatgtttcacccggacccttcggtcatcaccgtagatggcaatccgatcggcggcaaacggattgcgatgatcgccggtccatgctcggtggaaagtgaagcgcagatctgtgggatcgctgaagatgtaaaaaaagccggcgcgatgtttttgcgcggcggcgccttcaagccgcgcacgtcgccgtatgcattccagggactgaaatacgatgggcttgagctgctcaaagaggcgcgcgctaaaacgggacttccgattgtgacggagattatgtcgccgtatgacatcgaaattttcgtccgcgatgtcgatatcatccaggtcggcgcgcgcaacatgcagaatttcgagctgctcaaggagcttggccatacacataagccgatcctgctaaaacgcggcctttccgccacgattgaggaatggctgatgagcgcggaatatatcatgtccggcggcaatgagaacgtcatcctgtgcgaacgcggtatccgcacctttgaaacatatacgcgcaatacgctcgatttgtcggcggttccagcgattaaaaagctcagtcacctgcctgtgatcgtcgatccaagccacgcgacgggaaaatggtggatggtcgagccgatggcgaaagccgccgttgcagtcggtgcggacggcttgattattgaggtgcataacgatccggccaacgcgctttgcgatgggcagcagtcgatcaggccggccgtgttcaatgagctgatgcatgagctgcgtgcgatcgcgtcggcggttggacgcgaactttgatcggggcggggtgccggtatggatgatttgacacgataccgcgctgaaatcgacgggattgacgcgcaaatgattttgctgtttgagcggcgtatggatattgtacggcaggtggcgctgtataagaagacgcgcgggatgcctgtgtttcaggcgggacgcgaacaggaggttctggacaaagcggccgcccgccttgtcaacaaagattacgccgatgaagcgacgcgttttatgaatgtagtcatggcgatcagccgcgcggcgcagcggcgtgacattggggcattggagtttccgcgccgttcgcatacgcttggaggacccgtcgcgttttacggcgcgccgggcgcattcacggaacaggcgttgattgattatttcggtgatgggcgcgaaagcctgtcctgccaggaatttgaggatgttttttctgcattgaaggatgggcgcgccgactatggcgttctgccgattgagaattcttcgacaggcgcgatcacacaggtctatgatctgctggggagctacggcttttttatcgttggagagcgccgcctgcgtatcagccagaatctggtcggtacggcgggcgcctcgcttgagacggtgcgggccgtttattctcacgaacaggggttcgaacaggcgagcgcatttctggcgcggcatccggcctgggagcatgtgccttattacagcacttcgcgcagcgcgcggcatgtcgcgcgcgcaaacgacccggcgctggctgcgattgcaagcgcgcgtgcggccgcgctttacggtctggaggtgattgcgccggatatccagaacaatcaaaacaattcgacccggtttattgtgattgcacgcgagatggagcctgaaggagcagacaaggtaagccttgcttttacgcttgacaatgaatccggtacgctttacaatacgcttcgccactttgccgaacggcgcattaacctcgtcaagatcgaatcgcgtccgatcccggaaattctgtggaattaccgcttttatctcgactttgaaggtgatatcggccataccgatgtgcgcgatgtgcttgcggatatctcgcgcggcgcgcgtgatttcctgctgcttggcgcttaccgcagcgatacgcccccgctttgagagatgcagcggctattaaaacaggctcccgccgatccggcagggagcctgttgtcctgtaaggctttgggcattttaaacgcgccgccgcgcatatgatattttgaaggtacggccttcggcgtttattgtgcggcgcattgacgcaaaaagtgcgcgccggtataataaaatcaggcgcggcgttgggaggagcggcatggtacagaggatcgcggcgatcaacgagtgggtcggcagcctcgtatggggaccggccatgatcgttctgatgctgttggcgggcgcgtactttacagtcggaacaggttttttccagtttcggaggttcggcctgtggattcgctccacacttggcgcgattgtgcgcggcgggcaggtgcatgtccacgatccccatgcaatttcccagtttcaggcgctttcaacggcgttggccggaaccatcgggacggggaatattgtcggggtggcgacagcgattgtcgccggcggcacgggcgccgtcttttggatgtgggcgtcggcgctgctcggcatgatgaccaaatacgccgaaaatgtccttggcaacctctatcgctaccgcggtaaaacgggcgactgggtgggcggtccgatggtgtatatcgaacgcggcctgcattggaaatggttagctgtgctgttcgctttgttttgcgcggcggcgtcctttgggatcgggaatatgacgcaggccaattcgatcgcgggggcactctctgacgtgttccggatcgcgccggccgctgcgggcgttgcggtcgccactgtttccggcgtcgtaattctcggcggcgtgcggcgtgttgcagcggtgacagaacgtctcgtgccgtttatggcgctgttttatacagtcgggggacttgtgattatctttctcaatcgcgcgcagataccggacgcgttcacctccattttccgggaggcgttcagcctgcgggcggcgggcggcggcgcggctgggactgtaatggcgaacgcggtccgtttcggcgtggcgcgcggcgtctttacgaacgaagcggggcttggcagctcggtaatcatcaattccgcttcgaatgtcaaggagccggtccagcaggggatgtggggaattttcgaggtgtttttcgatacgattgttatgtgcacgattacggcgcttgtaatcctgacttcaggtgcgcatcttggcggcggagacggcgcgcagcttgctgttgcggcgttttcgtcgggcttcgggcggtttggcggcgctttcatatcgattgcggtctgctgttttgcatttgcaactattttaggctggtcgtgctatggcggccgtgcggtcgaatacatgttcggcagacgtgcgctgacgccgtataagcttctgtttatcgtgatgacatgggtcggctgtacgggaaacctcaaactcgtttggagtgtatcggatacattcaacgggctgatggccatcccgaatctgatcgcagtcgtcttgctttccaaagaggtatttcaggcgacgcgcgcttatctggcgcgaaaaagaaagggacggttaaatgggatacgacatcattttactcgacgcggatgacaccctgttcgattacagccgggccgagcgcagcgcgctggagcgcacctgcgaggcgttcggcgcgccgtttgacagccgggtgcttgaacagtaccatcagatcaacgacgcgctctggaaacagtttgagcagggcgccgtcacccaggatgctttgcgtgtgcgccggtttgaaagcctgtttgcgtttcttggcatccatgccgattgcgcgcgggtcaatcgtttctatacgcgcgcgctcggggaaggagcctttttaatggatggggcggaggaattctgccgggcgctgtcggcgaggcggccgctgtatatcgttacaaacggcgtaagcgaggtgcagcggtcgcgccttgcgcgcgcatcaattgcgccctatatccgtgacatcttcatttcccaggaaatcggcgcgcccaagccgcgcgctcaattttttgaccatgtatttgcggcgctcggcaatccttcgcgcgcgcatgcgattatcatgggcgattccttgacctcggatatggccggcggaaagaacgcgggaatcgcaacctgctggtttgcgccggacgacgctgtcgatacggtcggctgcgattaccgtgtgagccgcctcgcaggcttcctgcctatcgcgctcggcgcataaaccggtgaaaaacgtaaagagggcctgcaggcaggccctcttttgattgacaaatattcgagcgggacatataatcaaatcaaagcatatagcctgttgttatgcattggggttgtcagctatacgaatacttccccaaatatctattacaggagaggatgaaatggcaagcacttcccgtatgatacccttggccataattttcctgctgctcgctctcatcgctataatagctgagcggaatccgtcgcagccgggtgatgagcctgcctttacaaaagtgcaggaggtggcggcgggagatacgctgaacctggaaggaggagtctctgtctgtgtggagcggcccggttttctcaacagccttatgccttttggcacagtaataggggttcacacctatctgatcgtcaatccggaagacaacgagaaaaactgccttagcgtgttgcaggtggaaattgaaaccgaccgggatttggaactcgcgggccggttatcggccggaatccttacgccaaatgggaaattttatgaaggggactgctatatccctgatagttccgggcgtttacccagtgagacgcttcatgaagttcctgcgggagtccgtcgtgtgtactttgtgtcgacggttccacgccgtttggcaaaaaaaagcggtgagtttcagttttgcctgtatgcggatggtacaaaatatacgctgccgttttccccggggcttatggaacctatgctgaaggccggcgatacactcgaaaatggtgattaccgcctggtgttggtagatgcacggcagggggatcggatttctgcctccaacgatcccgaaacctacatgttccagggcgccaaatcttcgtataacggctacatagagatcgttgcggacattaccaatctgtctggcagaacagaaaatattttacgttctgttgagtgccgccgggtatttgatggatatgtggaaggccctctgagcagttctatcatggaagacgaggatatgacgcattttacgcctatggggctttacggtgcaggtgcatctggcagccgcagcggaatacatatttatcatggtgtaggagctgtcaataactcagaaattcctcctggagagacacgcagggtacattttttctgggatcgcagcgatgaggctgctgcgcaggaggaacaccttatacgtattcatatgggcggcagcgatggctacgtgcgtattgcttaaattctgccctgccggggaagatgggcggccgtatgtatattttgcttggtcggattgcatgtgtttgaaataattgatggtatgaatgaaaagcgaggactcctgatcgtttgggagtccccgcttttcattttacaaattcgctaacaaattacaaatataaccaggcagcaaggatgaatttaactttgattatttcagatcgtcaagcgatacaatcggctttgctgtaaaaacataccggccaagcttgtcaatacgggcgataaaagcgccgcgtccatttgaatccgccccataggtaaaacggcttgtcacatcctgaagatcgccggtttccgttacctcatagatatgcacatctccatgggggaccgtttcattgccgtcaaaggtgagaaagggatttgtcagcgttaatatcgcgccattgacggacggatagtttgaaaagaaacgcgtatagtattctccaagcggtgcggtgtgatcgcggccggtgtcggaacggcgcgtggacagcttcgacatataggtatagtcgccgccgttgagctccgcgacgataatatcagaatcctcccaggtatagtcgctgtcgccgtccttgctgggataaagaaagatatcctcagcgccggccgcataagggccgtccttaagcgtgacaacgtcgccgtaccagtcgggcaggggatttagatagctgctggccgacaaatcgtcgccggtgatgtccgcacggtagttgagtacgatcttcgcgccgcggcggacatcgagcgtttcggctgtgccggcgttcttcccggtcgttacaaccggcagtttgatatccttctgcgctgtgtaggttactgtaaagccgactgtcacgccctcgtcgacgagataatcctcaagtgtgatgacaaacgccgcgccggagccgacgatttcaccgccggctgcctcgatccgctcgacagacatcggtccaatcgttgttttgatggcgcgggtaaacgcgctgctgtcattaaacagcgcgctgtcagttacacggtagagattgccggcgtcgtcataaacgcgctcacaagcggcgacggtgacggtgttgccatacgttttataacggccggccgggtcggtgcgaatcggctcatagtcataaacctttgcgccgagagaggcttcggattgctctgagagggtatgcgtcctttcagcggcaaatacaggaacacagagcgcacaggcgcaaacgaatgccaatacgcgggcagataatgattgtttcataagcagccccttcttattaaaatatttcaatttttatcacttctaactatagctccaaaaacagccgttcgtcaactgaattttggaaaagttaaaaaacctttaaaatatcggcatttttgattacaaaaaagcccatccaaacaagataggaaataaactctaaagtttacaaattagacttgatttttccgattgaaaggggtactatatatttagcagtctaatatgtagagtgctaaatatgttaaaaacacttttatatataggaggggtgttcagtgaacgctcagaaatttacgcagaaatcgctggaagcgatccaggaagcccagaacatcgcgaccgattacagccacatgcagattgaacagcagcatttgctttgcgcgcttgcctcgcaggaggacggcctgatcggccagatgtttaagaaaatgggcgcggaccccgctgccgtagcagaagccgcgcgtgatgaggtcaagcgtctgccgcgcgtcagcgggccggggcgcgaacaggggaaaatttatgtcacgcatgaggtcgaccaagcgctcgtgcaggctgaaaagctcgccgaccgcatgaaggatgaatatgtttcggttgaacatatcatgcttgcgctgctcgagatgccgaacgaaccgctcaagcggttgtttgcgcagtttaatttgacaaaggacgcattcttatctgcgctgatgagcgtgcgcggcaatacgcgcgtcacctccgacacgccggaggacacatatgacgctctgaaaaagtatggttccgacctggtcgaacaggcgcgcgcgcaaaagctcgacccggtcattggacgcgacagcgaaatcagaaacgtcatccggattctgtcgcgcaagacgaagaacaacccggtcttgatcggcgaaccaggtgtcggcaagacggccatcgcagaagggctggcacagcggattgtgcgcggcgatgtgcctgaaaacctcaaggaccgaaccattttttcgctcgatatgggcgctctgatcgcaggagccaagttccgcggtgagtttgaggagcgcctcaaggctgttttgcaggaaattaaaaagagcgacggccggattatcctgtttatcgacgagctgcatacgattgtcggcgcgggcaaaacggaaggctcgatggatgcgggcaacctgctcaagccgatgctggcgcgcggggagctgcattgtatcggtgcgacgacgctcaatgaatatcgccagtacattgaaaaggacgccgcgctggagcgccggttccagccggttctggtccccgaaccgaccgtcgaggacacgatttccatcctgcgcgggttgaaggaacgctatgaggtgttccacggcgttaagattcaggaccaggcgctgattgcggcggctgttttgtcaaaccgttatatttcggaccgtttcctgcccgataaggcgatcgacctcgtggacgaagcgtgcgccgtcatccgcacggaaatggattcgatgccgtccgaacttgacgagatttcgcgccggattatgcagcatgagattgaggaggctgcccttaaaaaggaaacggaccggctgtcgcaggagcatttgcatgagatccagaaggagcttgccgagatgcgcgagcagtttaaggcgatgaaagcgcgttgggaaaatgagaaaaacgctatttcaaaggtgcagaagctgcgtgaggagcttgaacaggtaaacgccgatattgaggcggccgaacgcacatatgatcttaaccgggcagccgaactgaaatacggcaggcttccggctttgaaaaaagaactcgaggaggaggagaagcgcgccgaaacagcggaaaaggattcgacgcttctgcgcgacaaagtaaccgaggaggagatcgcgcggattgtcgggcgctggacaggcattcctgtggcgcggctgatggaaggggagcgcgaaaagctgcttaatatggaatccattctgcacgaacgcgtcatcgggcaggatgaagctgtttccaaagttgcggaagctattctgcgttcgcgcgccggcatccaggaccagggacgcccgatcggatcgtttctgttcctcgggccgacgggcgtcggcaagacggagcttgccaaggcgctcgcacaggcgctgttcgacgatgaaaagaacatcgtgcgcatcgatatgacggagtatatggaaaaattcagcgtcagccgtctgatcggggcgcctccgggatatgtgggttatgaggagggcggccagctcaccgaagcggtgcgccgcaaaccgtactcagtaattttgttcgatgagatcgagaaggcgcatcccgatgtgttcaatatcctgcttcaagtgcttgacgacggacgcatcaccgattcgcaggggcgcacggtcgattttaagaatacgatcatcattttgacatcgaacctaggctcgccgtatatccttgatggtatcgacgcgtccggcaacatcacccaggaggcgcgcgatgcggtggagggcctgctcaagcagcagttccgtccggaattccttaaccgcctcgatgagatcgtattttataagccgcttcagaaatcggagatcaccaaaattgtcgatctgctggttgcggatttgcagcgtcggctgtctgataagcagcttacgctggaattgacgccggaggcaaaatcgtatattgtcgatcagggatacgacccggtttacggcgcgcgtccgctcaaacgctttttgcagacaaaggttgaaacgatgctggcccgcatgatcatcgcggacgatctggcgcccggcacgcaccttgaagtgtatatggacggcagcgcgctggcgatccgtgcgaaacagtcatgacagagaggggacagaccattggaaacgaccatcaggcagtatacggaaaaagatcttgcagcagtcacaaaaatatggaacgaagttgtggcggagggtaatgcctttccgcaggatacaccgtttacgccggagcaggcgcgtgcgtttttcgcttcacagtcgtttacaggcgttgcggaaagcggcggacgcatcgtggggttttatatcctgcaccccaataatgccgggcactgcgcgcatatagcaaacgcgtcctatggcgtatcatccgaagcgcgcggcacagggatgggagagcggctcgtacggcactcgcttgaaatgtgcaggaagcatggttttgttggacttcagtttaacgctgtcgtatcttcaaacacggcggcgatccgcctgtatgaaaagcttggttttgagaggatcggcacggcaaaaaacggctaccgattcaaggacggccattatgaggatcttttcctgttcaataagccgctgatctgacggttttgccgttcaggccgcccggccctgtgccgggcggccggttttttcgagtgaggattcagctttccaaagattatagttgcacacaacggggaaagatggtaaaataaccgcaaagcggttattttttaccggggtatgccgggcggctcgccgcttgcgcggcaaccgccttgaaatgggcaatgataccatgccgcttcgcgggcagggtatcatatactgcggggagcacaggagccaaggctcctgttttttatgtaaagtttattgacgtgcgggcgccggtccgcggcggcgcgccggtcaaattttggaggaatcggattgtcggattacagaagcgaaattgagcgccggcggacgtttgcgattatctcgcatccggacgccggcaaaacgaccctgacggagaaattcctgctctatggcggggctatccagctcgcgggcgcggtcaagggaaaaaagaacgcccgccacgccgtctctgactggatggagattgaaaagcagcgcggaatttcggtgacatcgtcggtgatgcagtttaattacgaaggcttttgcatcaacatcctcgatacgccgggccatcaggatttttcggaggacacataccgcacgctgatggcggccgattccgcggtcatggtgatcgacgcggcaaaaggcgttgagccgcagacgcgcaagctgttcaaggtctgcctgctgcgggatatcccgatttttacgtttgtcaataagatggaccgggaagcacgcaatccgtttgatttgatggagcagatcgaacaggagcttggtatccgcacctatccggtcaactggccgatcggctgcggcaaggagtttaaaggcgtttatgacaggcataagcgcgaaattatttcgtttctcggcgacggcgctgccaatggcgtgcgtcaggtggagaaagtggagctgtcgctggaggacgcccggctcggcgagatgatcggcgaaacacaccgtcaaacgttggtcgatgatatcgaactgctcgacggagcaagctatgattttgatatggagcaggtgcgccacggccggctttcacctgtatttttcggctctgcactcaccaatttcggcgtggaaccatttttggaggactttctcaggatgacgcccccgccgctcgcacgcgaaagcagcattggcgtgatcgatccctttgaggatcgtttctctgcgtttgttttcaaaatacaggccaatatgaataaggcgcatcgcgaccgcgtcgcgtttatgcgtatttgttccgggcgctttcaaaagggcatggaggtcctgcacatgcagggcggcaaaaagatcaagctgtcacagccgcagcaattgatggcgcaggatcgcgagatcatcgacgaggcgtatgcgggcgatatcatcggcgtatttgatccggggattttttcaatcggagatacgatctgtatgccggacaaaaagtttgagtttcagggaattccgaccttcgcgcccgaacatttcgcgcgtgtccgccagaccgatacgctcaaacgcaagcaatttgtcaaagggacgatgcagattgcgcaggagggcgccattcagatctttcatgagccgaacaccggcatggaggaggtcatcgtcggcgtcgtcggcacgcttcagtttgatgtctttgaataccggctgaaaaacgaatacaacgtggaaatccggcaggagggcctttcctatcaatacctgcgctggattgaaaatgaggaattcgatccgaaacagcttgacattacctccgatacaaagcttgttcaggatttccgcgaccgttatcttctgctgtttaccgatgaatggaatatccgatgggcgcaggaaaaaaacccatggctgaaacttgcggaattcggcaggtcgtgacagtaaagtcaagagaatggaaaagggcgggtgtttcccgccctttctttggtttttactgcggaaaatagggcttttgttttatagcggggagtgatataataaactgtaagaaagatccgtttccaaaacggtgaaggggaaaggagattcgtatgaaaaagcgtgttctgacagtttgcgccgcgcttgtccttgcggtcgctctgggcgttttggcttatgcggcggacggcaatctctacagcgtttccgtttcagggaaaaatatttcgtttgtttcgggcggccgggttgtcggtacatatcaggcgtcgtcgacagatctgaagctcatgaccgacggcgaaggcgatctgcttgtttgcttccatgcaacggacggtcgttatcttggcgtgacgcttggaaagcagacgtcggtaacgattcagggcgtgatgtcgtctctgacagttgacagcagcctgaataaaagcgttcaagtggtggtcggatcttccggcagcgcgggaattatgtatgtctattcgccggtcagtgtggtaattcagggaaatgtcggtacgctcaatgtggcaacttctgcacaggtgacactgtcggatggcgcgtatgttacaaaggcgaatgttgacagttcggcgacgctcaacattccgtcgcgctcatcggtcggcaatattgacgatgtggagagcggttccagcacatcatattcgtcctccggaaagatcaaattccgcaccaggacgatctatgccgacagcggcgatcgactgcgcgacctggtatatgagcttgaggataatgtcacggcctattataacaaccgaaagatttccggcgatgtggaatgggtgacatcggagaatacaacggtccgcaacaaccggtattaccggttccgcttcatcccggacagcagtaaatatgacgaagccaccggaaccatccgcgtgcgtgttgacgacgatgataacagcgacgagaatgtttatctggagatcgacgagatctatgcggacaggggggatcgtctgcgcgatctgcgccgtgatctgcgttcaaacgtaactgcctataacgacaatgacgacgagatttccggggatttcgaatgggttgaatctgggagcacgcgtgttgaggacggcgaggagtataaattccggtttattccagatagttcacgatatgagcgtgtgacagattacatcacaatttatgtcgactgataactgtgtttctgcatttttctaaaatcatgaggaccgtccgtatgaggaatgattatccgcatacgggcggtttttcatatttcgtcaatgttttgcaattttgaattgttttcagttttttcatacaaatttcgcgcggaacagctataatgtataggcgctgtaaaatcggcgttctatttttgtgattcggaggcgtccgcattgtctcagtcagcggtacagataccaagaaaaaaacgaatggccgtttatggcctgacgtttacaagcagtgacgcgcggcttgccgtaactctttcagtcccggtaatcgcgctgtttacaacagaatggattcatcgcggcaccttggatggctttgccgctgtcctctccgcgcatctttggagctttgttttagcatggctttttttgcagttgacttatcttgttgtcagccgaattacaggctttcattcactggcggttttaacaaccggtatcgtgggggggcttcccgctgccattacctactataagctgcaaatccgcggcgaaccatttttgccgtgggatatatcccaggcggcggaagccagcgccgtgattggaaaggcaaatattgagattcagacctccatgatctggacaattatcattttttctgttttatttttattgacgcttcgtttgcgtgaaccgcgcagaaaagcgaatccaagcggctggcgcagacgtgtgattacaggcggtgtttcctgtattctgctggggacgctcatattcggggtctatttaaaaccggccgctacactctattttggcatcaggccggatatgtggatgcagaaccgttattacagaaatcacggcgttatcacaggatttctttccaacttgcaggcgcttgatatttcagtccccgacggctacagtgagcagactgtgcgggagctggttgaacaggtttcggcgaacgctccgcgtgcgccgcgttatgcggacagctatgcggcggcagccgccgagcctgaacagaaaccgaatattatttttattatggacgaggcgttttggaatgtaaatgagctgccgggcattacatacagcgagccggttacgccgacgctcgaccgcctcaggcagacagcggcggtcggcaagtcctattcgccaagctttggcggcggtacatgtgacgtggagtttgaggcgctgaccggttattccgtggagcatctgccgcttggtgcaaagccttaccagcagcatgtgacgcgcgacatgttcgcacttccggcttatttgaagggacagggctatgacacgttggccatccatggcttctaccgtaaatattggagcagggacaccgcttatccgcatcttggaattgaccggtttgtcgcgatggaggattttgtgaatccggagcgcaagcgcagcgaggaatggagcggaggtttaattacggatgctgagatgggccggcgcatcatctccgagtatgagcagcgggatcgggacaagcccttatttattcatgcggtaacgatgcagaatcactccggctataatgcgaagaactatccgcaggaggagcttgtcaagattacaagcgcacccgacggtatttcccaggaaacgctttcacagctccaggactttgccaccggcgttcgggaggccgacgagatgctcggtacgcttgtcgattatttttcaaaggttgacgagccaacgattatcgttttctggggcgaccattacaacactatcggcaaaggctatgaactttacgagaaaacaggctatattgagccgggcgacacttccagtccgaacctgcatggtacgcctttggtgatctggagcaattattatgacaagccagtcgaccttggtacggttgcggcatacgatatctctccggtgatgatggatctctacggacttgaaaagccgctgatgtttgaatttctttcacaggagatggacgttttccgcgcgcgttcgcgtgggattactgtcaatccggacggctcattctcggagcagatgacgccggaacaggagcagtggtttaacgatcactggctgcttcaatatgatatgatgtttggaaagcagtacgcggaaaaaatcggtgctctctgaataaaaaatccgcagccgggctgtaagcccggctgcggatttttttgctgaaattttgtccatttgtccaatcgggacgaaataaatttgtaacaagctccaaaattaggaaatagtaattgacaaatggatatttttgcaatatccttaatgcaaaagaatacgtgctcgtgcacgaaatgctgcagcaacctgatgcagcggcagatgcgcaaaaagaaatagttgcaaagcaactatttctttataaacacttttgtgcacgagcacatttacgctgtttgtatcgatcaacctgtttccaatccgctggagagcggtttaaatatgaatcaagaaaaacaggagtgaaggaaatgaaaaagattttagcaagtatcctcgcgtccgctatggtattctcactttcagcctgcggcggcagtgcgccggcagaaaactcggacgctgcgcctgcggcttccgcggcaccggcggcctccgctgcgcctgctgatgagagcggttcgccgtccacagtggcgggcggcggcaagatcggcgtttcgatgccgacccaaagcctccagaggtggaatcaggacggaaccaacatgaaggcggagcttgaagcggccggatacgaggtcgatctgcaatatgcaggcgacaacgacattccaacacaggtttcacagcttgaaaatatgatttccagcggatgcgatgcgcttgttgtcgcttcgatcgacggttcggcgctcactgaggtgctcaaaggcgcgaaggacgccggcatcccagtcatcgcttatgaccgcctgattatgaacagcgacgcggtttcctactatgcgacctttgataattataaggtcggcaccattcagggcaactatatcaaggatgcgcttgatctggacaatgcggaaggacccttcaacattgaactgttcaccggcgcgccggacgacaacaatgtcaacttcttctttggcggcgcaatggatgtcctcaatccatatatcgagagcggaaagctggtcgtactttccggtcagacggaaaaggcacaatgcgccacgcccaactggtcggcggaggaatcccaaaagcgtatggagaacctgattacctcaaatggttacggcccggagggtacaaggctggatgcggttctctgctcaaacgattcgactgcctacggcgttcagaacgctttgattgcggccggatacacgcctgaaaatatgccgattattaccgggcaggactgcgacaaaccgaacgtcaagaacatcgttgccggctaccaggatatgtcggtgtttaaggatacccgtacccttgcttcccaggttgtcaaaatggtcgatgctgttatgcagggttccgagccggagatcaacgacactgaaacatatgataacggtaccggcgtcatcccatcctatctctgcgatccggttgtctgcaccgttgacaattacaaagaactgctcatcgacagcggctattacacagaagcggacgtagcctaaagcttgtttgaaaaagctgagtaaaccgtccaatcagacagcggttttcgggcgggcggaactgagtttccgcccgcccgtttcattaccggatatgaggagggggattcaattggcaaatgtcttgcttgagatgaaaaatattgtgaagcggtttcctggcgtccgcgcgctggataacgtcaatctggaggtcgaggaaggtgaaatccatgcgcttgtcggcgagaatggcgcgggaaaatcgaccctgatgaatgttttgagcgggatttatccctatggaagttatgagggcgatatcgtatatcagggacaggtctgccagttccataaaatcaaggacagcgaaggcaagggaattgttattatccatcaggagcttgcgctggtcccgtatctgacgattggggaaaacatgttcctgggcaatgaacgcggcagaaaaatacgcgtcgactgggatgaaacctacaataaagcggatgaactgctgcggatggtcggcctgaaggagtcctcccgcacgctgattaaggatatcggcgttggcaagcagcagcttgtcgaaattgccaaggcgctggcaaaaaatgtccggctgctgattcttgacgaaccgacggcgtcgctcaacgagacagattcgcaaaagctgcttgatctgatgatacagtttaaacagcagggcatgacctgcatcatcatctcccataagctcaatgaggtttcctatgttgcggataagattacaattatacgcgacggttcaacaatcgaaacgctggtcaaaggtgtggacgatttcagcgaggaacggattattaaaggaatggtcggccgtgagctgacagaccgtttccccaagcgcgagcaccagcagattggggagatcggaatggaagtgagggattggactgtctatcatccgctttatgaggggcgcaaggttgttgacagcgtcaatctcaatgttcgcaggggcgaggtggtcggcatcagcggtttgatgggcgcgggccgcaccgagcttgcaatgagtatttttggaaaaagctatggcgccaatatctccggaacgctgctgatggacggcagagaggtccagctgcacaacgttcaggacgcaatcgatcacaagctggcatacgtcactgaggaccgcaaaggcaacggcctgattctgagcgcccctatccgggagaataccacgctggcaaagatggataaggtcagccgccgccgggtgcttgataaggacttggaaattcaggtggcgaatgaataccgtgagaagctgcacacaaaatgcgcggatgtcgagcaggccgtggggaatctctccggcggaaaccagcagaaggtgctgttggcaaaatggatgtttgccgatccggatgtgctgattctcgacgaaccgacccgcggcatcgatgtcggcgcaaaatatgaaatttactgtatcatcaaccaattggtcgccgaaggtaaatcggtcgtgatgatttcttcggagcttccggaggtgctcggcatgtgcgaccgtatttatgtgatgaacgaggggcggatcgtgggcgaactgcctcgtgaagaagcgagtcaggaatcgatcatgtcctgtatcctacaatcgggcaaaggagcggaagtcagatgacaaaaacgaaagaaatcctgaaaaagaacaccatggtaatcgcgcttgttgtggtcatggttctattccaggtattgatctctgcggcgggaaaaggatccctgttcgcgcctgccaatatcaccaacctgatcctgcaaaacagctatgtcgtcattttggcggtcggtatgctgctttgtattctgacaggcggaaacatcgatttgtcggttggctccgtcgtcgctctagtcggcgcaatcgccggtgtcatgatcgttaataacaagatgaatgtttatctgaccattgcggtctgtctgattatgggaatcctgatcggcgcatggcagggcttttggatcgcctatgtatgcatccccgcatttatcgttaccttggccggcatgatgctctggcgcggcctcgcgctgattgttctcgacggtctgaccatttccccgtttccggaggattatctcaagtatttcagcagcttcctgcccaatactgcggataacaaagggttggtctttggcgtgaccatcgcagtcggagcgattctctgtgcggtttatgttgtatcccaattgatcgaacgcggcaaaaaggtgcggaaaaattacgagctggagccggctggtatgctgtggggccgcctggctgtgatctgtgtggccgcgatggcgctttcattcctgcttggcaaaaataaggggattccggtcgttttaattttgctcggcgtaatcgttctggtatacagctattacacccagaataccgttcccggccgttatctttatgccatgggcggcaatgagaaggcggcgaagctctccggtattaacaccaaccggacccttttcttcgcctataccaacatgggttttctctctgcggttgccgcgcttgtttgcatcgcgcgcttcaactcagccgctccctcggccggcaccaactatgagcttgatgcaatcggcgcctgttatatcggcggcgcgtccgcatacggcggaacaggaaccatcggaggcgcggtcatcggagcgattttcatgggcgtgttaaacaacggcatgtccattcttggaatcgattccaactggcagagagcggtcaagggacttgtcctgctggcggcggtcgtctttgacgtgctctccaaaaagcgatcagccaaagcatgattataaaattaattccggcctgaatatccggcggggattttggccggtgcggaaggggataaacctgtgaattatctgattggtattgatcttggcacttccggaacgaaaacagttctgtttgaccagaacggagcggccatagcgtccgcgactgttgaatacccgctctatcagccaaagaatggttgggcggagcaggaaccatccgattggtggcaagccgctgcggcgacggtccgcagggtgatcgatgaaagcggcgtggcgcccgaagcgatcaagggggttggcctttcgggacagatgcatgggcttgtcatgcttgacgaggctggcgagccgcttcggcgcagcattatctggtgcgacgggcgaacctcgcaggagtgtgaggagatcactgcgcttgttggccgccagcggctcattgagattactgcgaatccggcgcttacaggattcaccgctggtaagatcctgtgggtccgccgtcatgaaccaaaactgtacgccaaatgcagacatattctgctgccaaaggactacatacgttatcagttgactggtgaatttgcaaccgaggtgtcggacgcatcaggaatgaacctgcttgacgtgccgaaccgctgctggtcaggggagattcttgaaaagctggagattgacggcgctttgcttgcaaagatgtatgaatcctgtgaagtcactggacagattaccccaagggccgccgcgttaaccggtcttgcggcggggactccggtagtgggcggcgctggcgacaatgcggccgcggcggttgggacaggcgttgttgaaagaggcagggcgtttaccacaatcggcacatcgggcgttgtgtttgcacattcagaccgtgtgacgattgaccctcagggacgtgtgcatacattctgttcggctgtgccgggagcatggacggttatgagctgcacgttggcggcaggtctttcgcttaaatggctgcgggatcaatttttcaccgaagaaatgaaaactgcggaagggatgggcgtcgacccctatttcctgatggatcaacaggccggacgggttccgatcggtgcgaacaggctgatattcctgccatatttgatgggcgagcggtccccgctgctcgatgagaacagccgcggcgttttctttggcctttcggcgatccatacaaagtacgatttgctgcgcgcggtgatggagggcgtgacctattcacagcggcaatgtctcgatgtgctgcgcggtatgggcgttgtctcgaccgaaatgctcgcctgcggcagaggcggaagcagcccgctctggcggcagatgctggccgatgtctatggctgcccggttaaaacggtcgtctccaaggaaggtccggccctcggcgcggcgatccttgcaggcgtgggcgcggggctttatccgaacgtgcaggaagcctgccgggagatgattcagacaaacccggcgcagcagccggatgcgcaggcctctgagcagtacgaacggttttatcaggtatatcaatcgctctacccggcgcttcgggagagcttccagaggctttcaaagctgtaacaaggaggacttggccgatgaaatctgtatttgacaaggaatttgcggtctatggcaaggtcgtggagggatacgattttgcgcccctgctcaaggcgctgcgcgaaaacagcgggaagcccgcagactgtacgatttatgttccaagcgaccccgcgctggaggcgcttgcggcttataggcttctttccgatcatctgttcggcgggatgccggttcagatcggctactgcaacggccataaccggaagctgaattgcctggaataccaccgcaacagtgaactgaatatcacagacgacggcgtggtctttcttgtcgcgccgctttggaaggtacgcggcggccggatcgataccggcgaggttgaagcgttcgccgcgcctgccaaaacagcggttctgctctatgaaacgaccctgcactacgccccgctgactgcgccgggcggggaggggttccgggtagccgtggtgctgccgcgcggcaccaacaccgaaaagcccgcgatcgggccgcagctctgtgaggaccggctgctctatgcgcgcaacaaatggctgattgcccatcccgattctgacgaggcaaagaacggcgcgtttgcgggccttaccggagacaatataacgattgagtgaggagaatcatccatgaaaaacatccctgaagttaaacttggcatcatcgcagtttcccgcgattgctttattatttccctgtctgaacgccgccgcagagcgattgccgaaacctatgcgtccaaaggcggcagtatctatgagtgtccaattgtggttgaaaatgaaaaggatatgcagaaagcggtcgcggatgtcaaagcagccggctgcaacgccttgttcgtttatctcggcaacttcggccctgaaacgcccgagacgctgatcgcaaaatattttgacggcccggttatgtatgccgccgctgcggaggaaactggaaacgatctgatcaacgggcgcggcgacgcgtactgtgggatgctgaattgttcttataaccttggcctgcgcaggctgaaagcggttattccggaatatccggttggaactgccggcgagctgtgtgggatgatcgatgattttctgccggttgcgcgcgctttgctcggcttggcgtctttgaaggtgattacctttggtccgcgcccgcaggatttctttgcctgcaacgcaccgatcaaggcgctctacgatctcggcgtcgaaattcaggaaaactcggagcttgacctgttggtcgcctacaaagcgcacgcaggcgacgcccgaatcgatgagattgtcagggatatggctgacgaactcggcgcgcagggcaatcagtatccggatctgttgccgcgtatggcgcagtttgaactgacattgctcgactgggcccagtccaacaaaggcgcgcgcgactatgttgtgttcgcgggtaaatgctggccagcgttccctaaggaatttgggtttgagccgtgctatgtcaacagccgcctcgctgcgcgcgggattccggtcgcctgtgaggttgacatctacggggcggtgagcgaatatatcggcgcctgcgtgaccggcgcgcccgttacgctgcttgatatcaataattcggttcctgcagatttgtatcaggccgatatcgacggcaaattcccttatactcagcgggacacctttatgggatttcattgcgggaatactccgttctgccggctgaaagccggcgcggtcaaatatcagcttatccagaaccgcctgcttgaaaacggcggcgagccggacttcacccgcggcacccttgagggcgacatcgcatcgggagagattacatttttccgacttcatgcaaacgccgacgcttccttacaggcatacatcgcacagggcgaggtgctgccggtcgcgacccgctcattcggcgggattgggattttcgcaatcccggagatggggcgtttttaccgccatgttttgatttccaagcattatccgcatcacggcgcggttgcatttggtcatgtcggcaaggcgctttacaccatttttgattatcttggcgtgccggatattgcgtttaaccaaccgaaggggatgctttatcccaatgaaaatccatttgcataaaagcctgcgccgattcttgcacatccggctgtcatagcgtataataaaagcattcaaggcaaaacggcgctgccgttttgcctgtttgttgaaaagggggaggagccggtgtccgttaccatcaagcagattgctgttgttgcgggggtgtcgcgcggaacagtggacagggtgctccacaatcgtccgggggtaaagccagagattgccttgcacgtgcgtaagatagcggacgacctgggatatgagccgaaccgtgcgggaaaaattctcgcggcacgcaagcagccgctcaaaatcgggtgctttcttccaagtattgggaacgcattttttgacgatgtaattgccggtttccagcaggcggaaaacgagctttccgatttcggtgtgacgcttgtattgcaggaagtggaggggtatgatgcgggcgttcatatccgtgcaatacgaaagctggtggaggccggctgccaggcgctctgcgtttcaacgatcgatacaaaagaaatccgggcatttcttaatcaattaattgattctggaatcccggtcattgcggtcaataccgatcttacaaaaaccggaaggctttgttatgtaggctgcgattatttgcaggcggggagtacggccgcagggctgcttgcgctgatggcgtcggatcagcttaatcttctgattgtaaccggttcgcttaaaatgaaagggcacaacgatcgtatccgcggattttcgcgtaccctccgggaaaagaaggtaccgtataagctggtcgacgtgtttgaggcgctcgataatgatgaatatgcctatcaaatggcgctggggaccttgagggcgcacccggagatcaactgcatctatattgcggcggccggcgttgcaggcgtgtgccgtgctgtcacagaacttgagcggcagaatcagatttacattctctctcatgatgagattgaatcgacccgccagttggtacaggatggcgtgatcgattttacaatcggacaggagccaaaagatcagggatactgttcggtacagatgatgtttgattattatatgagcggtaaacaggttgcgccgtgtaatcatattacaaatacggtgattaagatccgcgaaaacatcaattagaaaagcagaggcacggccgtttttgcggccgcgcctctgctttttaaacagcccttaatcaggcgaacggatttattttatgcgcgcggaccggcggcctcctgaaaggctttcgcgcgccgtgtaatttcatcaaaatcatgctttgcggcgagcgcgccgctgaccaagcaggacccgacgccgatcgcggcagcacccgctttgaagaaatctgcggcgttttcgagcgtgacgcctccgaccggcatcaggctgagctgaccgagaggaccgagcaaatcgcggatatactgcggaccgacgcttccaaccggaaacaccttgatcatcaacgcgccgagccgtcgggcctggagggcttcggtcggtgtaaaaataccgggaaccgcgagcttgtcatattgattgcacagggcgatcatatccggcgcaaggaccggcgaaagaagaaagtccgcgccagccagaatgcacagccttgctgtttgagcatcgagcacagtacctgccccgatcatcatccggccgcccacatgctttttggcgcgttcgatcatatcaaggccatgatcggtgttcattgtgatctcaacggcatagacgccgcctttgcagagcgcatccaaaacaggttcaagcgtttcggatggaacaccgcgcagaatggaaacaacacgatgctcgcaaagcttgttaaagatgtcgcagatcatttataaggacccctttctattgatttacaaagcaaggattcagcgcagttaagtctccaatggtttaaaaccgtcttacgtcccttcagaccgtctgctttgacaggcggcctttttgccgcggcgctttccgataaagcaacaggccggtgaaatcagccaaaaaccaaccgattgggatcgcccaccagattgctggcaggccgaatgcgggaatgggcgcaagcagataagccagagccacccgcgtgcccagtgaaacgactgttagaacaatggatacagccggccggccaattccccggaacaggccatataaaagaaacaaacatccgatgccggcgtagcaggcgccttctatacggagatactgcatcccgatcgcgataatctgcgtttcctccggcttgacaaaaatcagcatcaggggccgcgcgaacagacagacaatcagtgaaacaacagcgcagaacgccaacgcgcagaaaaccgcggatcggatgccgccgcggatgcgttcctgttttcccgcgccgtaattttgggcgataaaggttgaaaaggcgttgccgaagtcctgcacgggcatatacgcaaaggaatcgattttgacggccgctgcaaacgcagccatgacggagacgccaaagctgttgacaagtccctgaatcattaaaataccgaaattcatgaccgattgctggatacaggttaaaaaagaataccgtgcaatgttccaagcggctgtacgctcaaaatgcagatgttgtttttgaggacggatctgcggcacgcgcaggaggcaatagaccataatgctgccggcggaaacgccctgtgcgatgatggtagcccaggcggcgccggctacgcccattttaaacacaatgataaacgcgagatcgagcacgatattgagcaccgacgagattgacagaaaaatcagcggcacggcagaattgccgatggcacgcagcacacaggcaaaataattgtagatgaaggtaaaaaaaatgccaagaaagatcacctgcaaatatacaccggtttcagcgcgaatatccgcgggaacctgtaaaaccgtgagcagaggggagagcagcgcgagagaaagtatttcgatcacaatagccgccgcgccaatgagcgcaaatgagataaataaactatttttgagccggtcggtttctcccgcgccgaacagcatggaaaaaacgacgccgctgcccatacaaaggcccagaatgatcgatgtcaaaaacgtcatcagggtgaaggatgaaccgaccgcggcaagcggacccggaccaagaaactgtcctacgatcagcgtgtcggcgatgttatagagctgttgaagcagattcccaaggatcatcggtccggcgaaaagcagcatggattttgtaatggatccttttgtcaaatcaagcatgttgtgttccttccatatatcatcagacggccatgccggatcggcaaatggacatccatttcatcttacaacatgcggacctgtttgacaagcccctgccgtttgtctaatccgcttcgtcggggtatgcaaattcacgatcgattaaaaaccatgcgctgccgctgctgccttcaatggccagccatgcaaaatcaggaaagccgcattcctcgaaaaatattttttgtatgccaaattgctctgcttgtggcatataccagccggcggcttctgttccatcggaatgaatcaggcgtgccgaggcgtctgaaaacggcatggacacagtgcaaacgaccgtgtccgcgcccggataataaagcgcgctgtaaagaaaccatccgtcctgcgccgtatcgggaacagggcggccaatcagctcattgaggtccaggggaagccccgtttcgctttggactgttcgcatatgtgctgttgtaaagcgcgcgtcaataaaacgttgtttttgtatctgacgcgcacaggtataaaaaagcgccgcggcggccgccagggccgccgcgactgtaaaaaaccgcaaggatttattcatgcttgatcgcctccaatgcggagattttcatggcgcggttagccggcagaacgccggaaatcaggccaatcaatgttgcaaacgcaatggccgcggcgaccagccagagcgggatcactgagacggaagcgccgccggcatccataccgccgcccatcatcatataacccatgccgccgcccataccgccgctgctgccgctgaacgaaaaattaaagacattcatcagataggatatgccgtaactgaccgcaacaccgatacagccgccgaaaaatccgatgaccccggcctccatcaaaaaaacagaacgtatatttttaactttacagccgagcaccttcatcacgccgatttcacgggtgcgttcatagatcgacataatcatcgtgtttgtgataccgatggcagcgacaagcagggagatgccgccaaggccgccaagaaaaatctgctgctggcgggcctgttcctgcatgggcttgcgcacatcctccatagaatttgtatcgaagcccatcgcttcaatggccgcctggaccggctccacatcctccatagtctcgaccttgactgtgacattggtgtagcccttcttatcacggctgctggttgtgattttgttgacgcggttatactccttttcgagccatttgacatcctcaatgtccataatgatcccctgcgaggtgacccatcctttgtcataatcctctttcacgcggccaatcggcttgatttcacgcgaaaactgcttcgagtcgggatcgtcctcatcctgcttgtcgctgcgcaaaatcaactcgtcattcataatgtcgacaaatggttcctgcttcaactcgccgttttcatccatttcaggccaacggtagttgtcgaatttctttttggtatcctcaaagctgaagccggcgtattctccgacgacaacatagatcggttttttcttgtcggtctgcggtcctgcgggatattctccctccaaaagcgtataccccattttgggcatggcctcggcatacatgccggttacgtcatagagctgcatttgatagcggtcatccttgccggcataaatgcgcgcctgtagatttggggagtaaatcggcgtcgcaacctcaacgccgggcaaattctgtattttttcgacggcggcgtcatccatgaccgcattgtcgccgtcgctcattccgctgtaccggtagttcatgacatcaatcgtggtgaggcggctgcccatttgcgcgagcgtgttttcaagctgctgattcatccccagaccaagcgagatcataacgacaatcgcgcaggtgccgacgacgacgccgatcaccgtcaaaatggtgcgcatcttgcggcggaacagatttccaaaacacatggaaatcatatcagaaatcttcatcgtcttcctccagaagcacttcttccttctgacgcgcgcgcagaagcttgatgatgaacgccaggaagatgaccagaacgacgccgccgaccatccaggcccatacagggactgtctgataccacggtgtgacagccggctgatcatcgatgggcattccgccagtcatcatggagtcgtctgtcggctcgtcgtaagaaacagcggtcgttgtaaagggctgcctgatttcgctgacattcatgttggcgtcctcataggtgatgagaatttcaccggaaatctcgccgctttccgttgcgccgagcgtaaaggaagcagaatcctccttgccttcctctacattgccgatgaactggcgctggcctggttgagaaatgtttcctgaaatctcagcggtgacattgtaaacaggcgtctttcccttgtttacaaaattcacctcaacgcttgtatcgtcgccgacatagatttcagaaggcacctcgaccggatcgacagagaagcggttgagctgtgaaacggggatgctgatctcctgttccgcggtaagctgcttgcgttcctcgtcaatgaccgcttcatatgtaaaactgagcttaatcgcttgggaaaccggctcggcattcggcttgacagagacgccgattgtccgctcaacggaggattcacgcgacatcttttcgatatagaaggtatttgacgagcttgtaagcgtaagcgcctccggcatggtcagcttgacgacgatgttgtcgacagggagctttttgctcgtgtttgtaaaacgcatcttgagattgaaattgctcgcggctgtcacattgccgccgccatagtcgtattcggaaacgatgatcgtcggcgtgggaggcgcgatttccggcctgctcgaagattcgtcgtcgtcttcgtcgtcatacctgtcgtcgcgggaggtcttgtcgcgcacgatcaggtctccgatgctgtcgcgccgaaagctgcggacaatttcatttgatccaaccatcccatagtttacaacaagcagaagtttattcgtttcgcctgtgtaaaacagattgggaaaagtgatggtatatttgacgcccgttgtcttccaggtattgatctgctcgatcgaatagcccaggccgttgctttcgtccggctgaaaggtgtccctgttgatgttgacgcgcaattggtcccggatggcaagaaattcatccctggaaacgccttcgtccgaaatttcaaccttcatggtgacatgtgtatttggacgtacttcactgacaggcgcgccgtcgttgttaaagaaggtcaggctttgaatttcagcgattgcgtcgtctgggctgttatcgctgcttgtttctgagctgctgctgtctgctgcagagctactgccatttgacgcggagctgctgcgctcgttgtcaggcgtggaatggtcggctttgtcagcctgtgcggtcaaacggccgccagacgtgctggaggaaacaaaaatgatgtcaggcgcgctcgtttttggcggcggcgcgctttcgggttcagcggaagtctgggcgctggaagacccttcctcggcataaacgcgtgtaccggacaggacggcggcgaatgaaatacccgcggccgacaacaaaagcaggacagcgaggatcagagaaagcgcgcgtgcgggaaaatgattcatggcgaaacgtctcctttttgccgcgcatcgtcaggcgccgcgggatgatcggtagaagcgccgcttgctggcggcgggggttcggggtcgctttgagaagtgtctgtatcctttactgccggtgtgcggccggcttggtgaaaaccatccgcaggatcgctgtccgggaataaaagcgtatcggccagcggcggtataggctcgtcctcagatgcatcaatggggccctgcggaatttcgtcgtccggaacgatcagctcgtcagggaggagggtttgcccctgttcgcttttgccgtcgtagatcggttcgtgggatacatcagaggtaatcgcgccgtcgatcagcgtaacaacgcggtcggcatagtcggcgatctcgggatcatgtgtgacgatgatcagcgtttgccggtaacggcgggcaaagcggaccatcattttcatcacatcaatggtcgtttttgtatcgaggttgccggtcggttcatccgcaaaaatgacctttggccgtgtgacaaacgcgcgggcaatgccgacgcgctgctgctggccgccagacatctgtgtcgggcggtggtaagcgcgttttttcaggcccactgcggcaagcattgtcattgcggccttgtcgcgcagagccttgggcgcgcccttaaaaatcagcggcagcgagacattttcaagcgccgtcatagtcggcagcagattgtaggattggaacacaaatccaagataccgctgccggaaggtggcaagctggttttcagacaggcgagaaatgtttgtttttccaatgtacaccgcgccgcgcgtcggcttttcaagcccggcgagctgatttaagaacgtcgactttccagagccggaagtgccgacgatacagacaatctgtccctgtaaaatttcgaggttgatatcgccgagcgcgacgactttttcgtcgcctatgcggtacaccttgcgcagatgccgcacgctgataatcgttctcagcatgctttttggctgtgccgtctgttccaaggccatccccctcgtttgatagaataccttctaataggtgccgcgttttcccctgtttactgcatgtgttttcatataagtttagaaaaattatcacataacgcacacaagccgcaccgtcaaacagaactatgaaccgctgccgagcagagctgcaagctcgtcgccctcataaactatatagtcaaattcaaatgtatctgtcaaaaacatggcgatcagactatcaagatccgagacgatttcgtcggagacaagcgcaaattccgcttttgccccgatgactccctcgccggcgtgagcaaaggaaacgacgctggaccagccgccttcatattgtaaaaacagcagttgcccgccaggccagccatccggttcgatgtacgctttttccgttgtaagcagactggctgcggcaagcacagagacgccgccgagccggccgttaatgaaactggccgccatggcgccgttcatacgtttatagaggatttcctgcaaatcgtcagggagcgtttcgccgggtgaagccaggctgaaaatctgattgacgacggatggcggaagggcgatcaaataaacgcgtacaggtctgctgtaatcctgcgcgccgatttcatcagtcagtttacgtacttcctcagaatcggataccaggtccatatacatttgattggcggccatcgcgcccatttcctgtgtcagcgcaacgctctcctgaatacaaaatgcagcagggtcaaccttccgcggctttgctccgcaagcagttgcagccagagccatgacgatagcaagcagcagggaaaaacatcttttcatcacaagaaacgcctcttttgttatggatttcgttgccatcccaacagctttatgatagaataatcaaaatgtattgtcaatgcaaaaagccgtccctgggatatgcggcggcacagggaagggatggggcgcgaatatgccgcaaaaaaatgaactggtcacactggatatcatcgatatggcgcatgatggcaacggcgtcggccggttggacggtatggctgtttttgtgcccgcatcggctgtaggggatcgcctgtgcgtgcggattgttaaggtaaaccgcacgcattgctatggacgaatcgagcagatcttgcggccctcaccggatcggatcgagccggactgccctgtcagcaggcggtgcggaggctgtgtgttccgccatatctcttatgaggcggaattgcgctgcaagcaggcgtttgtccagcaaaacctgaggagaatcggaaagttggagcttgcggcagagcctattgagccgtcgccagtcaccgatgggtaccgaaacaaggcgcagtatcctgttcggatgcaaaagggcgggctgtgcgccggcttttttgcaccgcgcacacatgaggtcatcgactgccacacctgtaaattgcagccgcctgtttttggggagcttttggaggcggtcctttcttatatgcatacataccatgtctcagcctatgacgagagcttaggggccggtcttatacgtcacgtctatctgcgtcgcggacatcgctcgggacagatcatggtctgcctggtcgtcaacgggacgcatctgccgaatgaaaacgcgcttgtcgatctcctgctttcccgctgcggcgaaatcgtatccattctgttgaatgtgaatgaacgcaatacgaatgtaattatcggcgagcacagccgtgtcctgtatggaaagccggccatttccgatgtgctgtgcggcgtgcggttcgagctgtctgcacagtcgttttatcaggtcaacagtccgggagcggagctgctttatggtgtggctgccgaatttgcggcgctcacaggtacggagacgcttttggatctgtattgcggtgcaggaacgattgggctttcgctcgcgcatctgtgcaggcaggtgattggtgtcgaggtcgttccgcaggcagttgaaaacgctgtcgcaaacgctgcgcgcaacggaattaaaaacgcgcgctttttctgtgcggacgcgggacaagctgccgcccggctcgcgcgggaaggggtgcggcccgacgttattgtgctggacccgccgcgcaagggctgcgcgccggaggtgctggatgcggtcgccgcgatggctccgcggcgtgttgtgatggtttcgtgcgacagcgccaccatggcgcgcgactgcgccgcgctcgcggcggccgggtattcgctccgccgctgccggccggtcgatatgttcccgcgcactgcgcatgtggaagcggtcgctgtgttgtcccgcttaaaaccagattgaaatatatcggatgagaccggaaaaatcataaaccggccaagtgaaaaaccaaacaacaatgcatatcgggaagtgggccatatgaacagatgtccttggtgcgaatgcaatgaaaagatgcggcgctatcatgatgaagaatggggcgttccgctgtatgacgatcaaaagcagttcgaatttttgatgatggaggtcatgcaatgcggattgaattggaatatgatgattcaaaaacgcgagatattccgaaaatgtttcgacgcatttgattttgataaagtggcggcttatggcggcggggacatagaacgcatcatgaatacggatggaatgattaaatccccgcggaaaattcaggctgtcattcacaatgcgcggtgttttcaggagattcgctcggagtttgggtctttcagttcatatatttggaagtttacaaacggcagaacctatttatatatggggcatcaaaaaggcgccataccagcaaaaaacggcttatctgatcttatcagtaaagatttgaagacccgcggcctgaagtatatgggttcagttactgtttattctcatctgcaggcatgcggtatgattaatgaccatctggagtcctgctttcgctatcaggagcttttggattgctctgatacagttttaaaacgcagggatcatgaaggatagggtaaaacgaatccgaaagaaacgtaaagggattggagacagcaaaaggagaggacgccatgcgcagcgtagaggatcgtatttttattgcgtcgtcagcagaaggaaaaaaatatgccaggatagtgaaggctagcttggaaaatatcggcagtgttatactgtggtcagataattttttcaggctgggggaatcgacgctggaaaacctctgtaaacaggcggctggatttgactacgctgttgtgctgtatacaaaggacgaccatgcggtcgtcagaaaaaagcagtgttttacagcgcgcgacaacgtcctgtttgagcatggtattttcacaggcgtcctgagccggtaccgtacgtttgcattgattcagaaaggagtgcgggttccttctgatttaagcggcattacctacatattctttaaaaatgaaaaagacttgccgcaggaatgtaaaaaaattaagggcaaaattcatgaggaacgccagatttcacgtatttcgatgctgccttccacagctacggcgctttcctactttgaaaattttgtaaagccggtatgcaggcatctgctgacaaaggattatgtattatcagaaggaaaacaacttgcatttaacggtatgaaacaaaagctgaatattgtgcttccgcaggcgctttcagaggatttaaagccgcggttttatgaattgaaaaagcgcgccggtttgcaggagtttcaaattccgggtatccatcggcattttacaggatatggacgtttaataggaggtaccttatatgatttgatggatatgccgacttgtctgaatgtgtcccgcaaggcggttgaattatatatgggaaaggattttatcggctccgccagccatatggagtgcatattcgcaagggaacttgagaattttcgcgccacccttcagtatttgattgacggcgacgatacagccagacatgtggcgtgcgttgtaaacgaggaggatttttcaaaggttggagtactgcaataaggattgtccgcacggagattatgcttgcgcacataaccatgccgtattgcggcaatagagacggcggcggtctgtcgaatgtgaataaaagagattaaactgtcgcagcgtcccactcgtgccaataatatccgaattgtccgtccttcaggacggctgggatttgaaatatttagatgatttcaggagaaggaggaagaatatcagtctgtctagtcaataaatccgttttacggatcagaaataataaatgctggaggatgatgcgaatgaatcatgaagcgcataaggggaaaattgtaaggagccagtgggcttctaaaatggggtttattctggcgacagccggagcggctgtcggcttgggaaatctttggaaatttccatatctgatgggacgcaacggcggttttccatttttggtggcatatttgatctttgtgttggcgctcggattgccggtaatgattacagagatgtcaatcggccggctgacacaaaaaaacccggtcaacgcttatcatgcgatcaatagaaaaacgacgtttatcggtgtcatgggcgtgctttccgcctttatcattttgtcttattacagcgtcatcggcggttggattctcaaatatatcgcgtcctatgcaaccaccttttcagcgccggctgatttttcggcatacgttgcccagccggttgaaccggttgtatggcatcttatatttatggctctaacctgctttatttgttataaagggaccaagggaattgaaaaggcgtcctcggttatgatgccggcattgtttatcctgctgattgtgttgattgtgcgttctgtaacattgccgggagcgatgtccggacttcgtttcatttttacaccggcggattccaatttcagcttcgattcaattgtggctgcaatgggacaagtattctattcgcttagtctcggtatgggcatcacggttacatacggcagctatctcaggcgcagtgaaaatattccgcgcagctgtgcgactgtggccggactggatacgatggccgcggtatttgcaggtatcgcgattttccctgcggtgtttgcgttcaatcttgaaccggcgcagggccccggacttattttcggtacgctgccgaatgtgttcggcaacatgcctgcgggcgctgtatttgcgattctatttttcgttttgatgttttttgcggcattgacatcggcgattgcgctgctggaatgcgttgtttcctatacaatggatgatcttcattggagccgcgtcaagtcggtgtttttgcttggggtcttgatatttttacttggcgtgccaagttctttgtcgttcggaccgcttggcgatatgttgattttcaattatacattttttgatttcatgggtgtgcttaccgataattttctgatgccgctcggcggtattgccatgtgtgtttatgtcggatggatctgggggccgcagcgtttgctggcgcacattgaatcggacggtgtgtctttcaagctgaaaaaggcgtggctgtggtgtatccgaatcattacgcctgtcctgattgtgattgtcatggctatgggaattgtcggaattgcccgagtagtcggaggctgacgccctgcttgcagacatttagaaaaagcggcggttttgctggagagcggggccgccgcctttttcgcgaattgtaaacgccaggaattgtaaaggctacattgttatgttacaatgaaaaaaagagacggaacaggtggcggtaaaatgaaagaggatcaatatctattaagctctgtaagcaatacattggatattcttgatcttttaaacgaccatgaggaattgagccttgccgaaatctgcaaaaagctgcatatgggcaagacaagtgcatttcgtatgctgtatactctggaggccaaacagtttgtttataaaaccccggatgccaaataccgcttggggatgaaatttgtccggtttgggagcaatatctcagagcggcaggatctcatggtgctgctgcgtcctgttctgcaaaaattgcgagacgaaaacaacgaaacctcgcatttggcgatacttgttgacgatacagagattgtatttgtcggcaaggagatcggcaacacctctatccgaatggcctcgcagatcggggtgcggatgccggcttattgcacaggtacgggaaaagttctgctggcctatcttcctgaagaccgattgtatgccgcgcttgagaagatgacattcaaaaagttgacctcagccaccattacgtcacaggaacagcttttacagagcctgcaaacgatccgtgccaatggctatggctcagacatggaagaaagcgaggtggggcttgtctgctatgcagctccaatccgtaatttcagcggtgctgtgatcgcggcgatcagcatttcgggaccgtcggcacgtatgcatcaaaaccgtgagaagcttttaaaggcccttataagcgcctccaaagaggcttccgcaatgcttggatatgaaaaatgaatagaagttccaatacatgaaacgatctcctttgcaatcatagcaaaggagatcgtttcgcatatagaactattgttgcttatttattgattatagcctaaaaaacagtgtaaaattttacaaaaaaagttttgatttatatttacttatcattaaaaatcacttatactaattattaagaaatgatatttcttataaagaaacaaaaggaggctgaaaaaagttaatccagcggtccgaaagaaatgagaaagtttaggaggcgtattatgaaaaagattatcagcatcacgctcacagcgattcttgtctgttccctttttgcaggatgcgcggggaaggcgcaaccggacgttgtccccagcacagcggagacagcaggcgccggcggttatccaacccctgaaaatcccatcacattaaagtttgggcatatttctcctgacacttcggacatgcatgcgaatgcagttctatttaaagaaacggtggaagaaaaaaccggaggcgccgttattgtggaaatttacccgaacggacagcttggcggtgaggaaaccatgttggattccatcttctccggaacaatggacatgggcattatttctgcgaatgtggcggcagcaaccatcccggaatttaactgcatcgtgctgcccttttattttgacagttttgaacaggttggttccgtaatcgccaatgaggagtattatcaaaagactgcggaaattgtggaaaaaaaggacgtccatttcctcgggacgccgctgatggcggcgcgcggaatcctgaatacaaaacacagcgtcaggacaccggaggatctcaagggcctgaaaatacgtgtcaacacaggttctatcttggctgatacgtttgatacgatgggcgttaccaccacgcagcttgcctttggagaagtctataccgccttgcagcagaatgtaatcgacggcctggacaacggtattttcgcttccaacatgatgaaatttacggaggtcgccaaatactttaccaacaccatgcactatttccagctcagcccgctgtttatctccgatcaggcttatcagaagctttccccggagcagcgcgatatcctgcgggaatcctgcaaagaggtagaggcgatcctggtggacgaggcgaataaatccgacgcgggcgcatatgaagttgccgaaacagagcttggcgttgaggtaatccatctgaccgatgaggaattccaggcgttccgggacctggtgcagccggtgtacgataaatatgtccctctgatcggcgaggagtactatgactttgtcacgagcatcaagaaatagaaactgttcggctcaacgctgaaggaaccggggaaaggttttgaggtatgaactatgaaaaaggttagccaggcgatcgatgggatcgagcggattttgcttgtttatccatttttactgttgggatgctgcatcgtgtttgaggtgttctccagaaaattccttggattcgggctttcctggcttcaggaattgggaaaatacatcatggtttacgggacgtttttaggcgccgcaatcgctgtcaaggaccgttcccatccggccatgtccgcgattaaggattctctgccgcggctgccgcggatcatggtcagcgtgctgacaaatcttttatgtgcgggctgcattggcgtggtcagctattattcatggatcaagctggccaattacatccgaatcggcacaaaaacctcgtccctctggggcctgccgatgtgggtgccgtttttggcgatgcctgtctgcttgagtgtaatggccctgcggtttctgctgcaatgctgtcttgaaccggcggatatcatgaaatccatgaaacagaagggaaaggaggagccttcatgattgttgtcgtatcgtttttcctgcttctgatcctgggcatcccggtttcattggtggtgctgatttcgtccgtattgggcatcgccgcgttttcagacatatcgctgatgctggttgcggaacagatgttcaatgggctgaataacttcgtgctgttgggcatcccgttttttatcatggcaggcaacattgccgcaaaggggagcatctccggccatctgatcaatgtcatgcgtatgctgttaggcccgatcaagggcggcagcgtgatcgccggcatctgcgcgtgcgcgtttttcgccgctatttccggctccagcatggcgacggtggtggcgatcggcaccatcatgatcccggcgctgattgagatgggctatcccgaggaaatggcggaagggtccatcaccgcgggcggttcgatcggcatcctgatcccgccgagcgcgccgatgattatgatctgcgttgccatgggcacttcggtgggcaagcagttcatggctggctttattcccggtatcctgctggcggccgtttggtgcgtatatatctattttaaatgtaaaaaaagcaatattcaggacacaaaggtatacacaaaagaagaaaagaaggagatatggaaaaagagcatctgggctttgctgtatccctttatagtgctgggcgggatctatttcggctttgccacaccgaccgaggcggccgcgatcgccctgatttatgtgattctgatcgaggttttcgtctataagacgctgacacttggacagatcgcccaggaggcctacggcgcgctcaaaacgtccggttctatcatttttattatttcctgcgcggcggtactcaactggctgatcaccacacagcagattccggcgctgatctcgggtatgatcgcggagtatgtcagcaacaaggtcatattcatcctgattttgatggcaattttctttatagccggctgtttcatggatttgatcgcgttgatcgtaattttagggccgatcctcgcgcccacgctgtcaattttcaacatcgacccgatcctgttcggcattatgtgcgtgatgtgcgtacagatttcctatattactccgccgttcggcctgaacctgtacgcgaccatgggtatgcgcaagcggaccatgatgcaggtaagcaagagcatcctgccgtacctgctgatcttgattgtcgttacgcttgcggtctgttttatcccgcagatttcattgtttttgcccaatatgatgaacgtatgattttaagctattgaaaaaggagaattattatgaacgaagttggtatcatccgtcatgacgagagcgagggcctgcgctttgggaaactgatggcggaatgctattactatatggccaagcatattgtggaggcgatgggggaagaacaaggcgcgcaggtgattcgcgcggcgctcaaggaattcggcgaggaccgggttgcctccatgaagcgggaagccgctgaaaaaggcgttgaagtaaccgattttgaaaagtattttactatccgcgacatgccggactgcggctggatcaatggggacgagcgcggcgtggtcaagcagtgtctgttccacgaggtctggaaacggtacggcgatcttgggatcaagctcggttcatattactgcgaaatcgactatatcctctacggcggatttggattccatctggaccggccgaaaaacaaatgcctgggggacgacgagtgcgtcatgcacttcacctatgataagtgatctggaggtacatatcatgcggacggcgcaatttacccgcgtaagctgcgatgtgctttgcatcggcggctcgggcgcggccgcttcagcggcgtttatggctgcgcagaaggggatgtccgtggcgctggtgtcaaaagggaaagccgggcgcagcggaaacgcgatgatggtcggcggcggatttggcgtggacggttacagcgccaggcatatcttgggagaggtacaggccgatgaacgctatacgccgcaggctttgtttgaaaaggtggtgaaggcttcattcttcctgtcggaccaggcgctggcggaacagtttgtaaccgaagcgccgccgatgacgaaacagtttctggaatggtccagagcggctggtcagaatttccctttcgtaaaaagcggcctgtatgcggtttccggaagctctgtcggaaaaaccatccagcaggggattaaaagcgccgcgggctgcaaagtgtatgacgatgtgatggttctggagcttttgaccgactgcggacgggttgcgggggcgttggggcttgatatctgcactggggactacattgtgttcgaagcgaaatgcgtggtgctcgctacgggcggatttcagccgcatacgctgaaaaataccatcagcgaaatgtccggcgacggtatggctatggctctgcgcgccggcgcacggctggcggacatggaatttctgctttatatcccaaccgctgtccagccgccgtatctgcgcggttccattctgccttatctgtttacaatcccagtgtttatgccgctctcttttaaggtgattgaccgcaccggcaagacgctcgacatccctgcgccttttgatgatgttcccggaagcaacaaactgaaaaaactgatttacagctatttctggagtaccggttccacgtgtgacacaatgaatggcaacctctttttcgattactccatgcacacggacgaacagatcaaccaggcgtttgatttctttacagagcattattcccgctggcataaaaagggcttttataacggcatcgaccttgccggggtgcgtgaattgatcctgcgggaacgcaggctggaatttgcgttgggcaacgagtacagcaacggcggcgtcgtgatcaacgagcggatgcagacggatcttgaagggctgtttgcggcgggcgaaacgaccagcggcctgtttggcgccttgcgcgccggcgatgggctgacggaaatgcttgcgcacggataccgcgccggcttggaggccgccgccttcgcggcgggagccgggcgccccgggaacctgtccgcacaggccgaaaaaatagtcgcggagcttgagtcggtctttgaaaggcccgccggggaaacgcgcgtgccgatactggcggcgcggcttcggtctctggcggacagcggcctgaatgtggtgcgcgatgaacaaaaaatccgctgcgcgctcgacggcgtgcgggaaatccgcagggaactcggacaggttggcattgcgtcaaaatcgcggcgctgcaatttggattacctgggctggctcgaactgagaaacctgtccgtcttgacggaggccgccctgctggctgccggccagcgccgggaaagcaggggatcacatatccgtgccgactatccaggcgtggacaatcacaattatctgtgccgcctgaccgcaaagctggagaacggccgcatggcacaggggcgcatccggccgagagccggccgcctgccgctgccggaccgggattacacttcagtcgccgactatctggcggatatcctgtgaggagggtgaaggatgaatgtacaggtgacgcgatgggaccctgaaacagacagccgtccccatttgcagctttatcaggtcccattgccggcggatggcacccatacggtgatggacgttctcgattacatctatgaaaagctcgacggcacgctttcctattaccggcacagcgtctgtaaccagggaatctgcgggcggtgcgcggtgcgtgtgaacggcaaggtgcggctggcctgtacctgccgggtttgggaagaatcgctcgaatttggcccgaaaaatgaaaacgttgtgaaggatttggtggtcaggtgaaggactttactgaggaactgattcagacgcttgacagccgccaacaggaactggcggatttgagccgggaaatttgggaatacgccgagctttcagaggaggaacaccgctccagtcggcgattggcggcatatctgaaggaaaacggatttgcagtcgaggagggtgtctgcgggctgccgaccgcgttctgtgcaaagtggggcagcggaaatcccgtaatttcgtttctgggggaatacgacgcgctgccgggcttgagccaaaaggccctgccggagcaggcgcctgtaagagccggcgcgccgggccacgcatgcggccacaatttgttaggcagcgggatggctggcagcgcggcggcggtcagggggttgctggagcgataccgtttgccgggaaccgtgcagtacttcggatgcccggcggaggagatcatgcttggaaaaatcgtgatggcaaagcagggcgcctttgacagctccgacgtctgcctgacatggcatccgatggccagcaatacggtgtccgactattcctattcggcgatgacctccatgaaatttacatttctcgggaaaaccgcccatgcagccgccgcgcctgaacaggggcgaagcgcccttgacgcggtggagcttatgaatgtcggcgcaaactatctgcgcgaacacatcatcccgcaagcgcgggtccactatgtgattacggacggcggcggaaaaccgaatgtggtgccggggcgggcgcagtcctggtactatgtgcgcgcgccttataaggaacaggtggaggagatcacaaagcgcctgatcgacgtatcaaacggcgcggcgctgatgaccgggacgaccgttatgcacgaggttttgagcggatgcggcaacaccatattgaacgggccgctcaaccgcctgctttatgaaagcatgacgcgtgtcccagttccggactggacgcaggaggaactggaattcgccaaaaaactccaggatacgtttcccgatcaggtgcgcagaaacgcgctgcttgaattttctgttatggaactggagggacagatccttcacagcggcgtgacgccgctcaaggccgcgccggccttccttgccggctccacagacgtttcggatgtgagcgcggcggtcccgaccgggcaggtctttacctgctgcatgccagtgggaacgcctggacacacctggcaggtcgccgcctgcgcgggtatgtcgatcgggcagaaggggatgctctacgcggcgaaagtgattgccgacacggcgatgcgcttgttttgtatgccggagcttttggcggagatcaaagcggattttaaacagacgggcggcagaaacgggggatcggaatgaaactggcggtcattgggggcgcggggcttctgggaagcacggcggcgttctgtgcgggcggaatggacgtgctggaggagatccggctgctggatatccgggaaaacatgacgatgagccatgtgatggacatggatcaggcgctttcgtcatgctcacgcacaaaagtaacaaagggggattacaagcggcttgaggattgcgaactcatcctgatcaccgccagcgttcccgaaactggaaccggcacgcgcgacagctacctgcaggcaaaccgggatatcgtgacggagatttgctccaagctgcgcgggctgaatcaaaaccatgtgattatcaacgcggtcaatcctgtggatgtgatcaatgttgtgatccaagactgcaccggcctgggtcggcgccagattatcggcttttcagcgaacgatacgctgcggctgaaatgggccgttgcaaaggtattgaatatcggggcggacagggtggacgccatctgcttgggtgagcatggggaaaaaacagtcccgcttttcagccgtatttttatcgatcaaaaacatgtgcggctggatgcacggcagaaggaggctgtgcttttggaaacgcgctcctggttttcccgctatcaggcgctgcaaagcgggcgaaccagcgggtggacttccggcgtacaactggcgcgtatcatagcagcaattgcgtccgacagcggacaggtgctgccgtgttccgtcatactggatggtgaatatggataccgggcggtcagtgtcggtgtaccggcgcgtcttggggcgcgggggatcacggagattatggagcttgcgctttccggtgaggaacaagggcagctcgacggggcggtgaagaaaatccattctttgctgcaatccatcaggaattgaatttaacaatcaaaggagggccgatatgatccggctgaaattttacggcctgggcggtcagggagttgtgaccgcagcaaaggtactgtcggcggcggtatcaatccatgagggtaaatatgccgttaccatccccgcctatggccatgaacggcgcggcgcgccggtgtataccgacgtggtggtggataatgaaccgattctgctcaactgttttgtgtatgagcccgatatcgtgcttgtaatggacccgtctgtaagggaaaaaaatattgacgtcggcaagggtaaacacgacggtacggttctggtgctcaatacaaaatcggaacgggaagcgtcggaatatatggagcaatacggcttccaaaaggcgtattataccgatgcggttgatgtggcgctgaaatggattaggcgtccgattccaaatggagcaatgcttggcgcgttaagcaaaacaggacttgtttccattgaatcagtgatggcggcgctgaaagaaacgtttggagaaaaggcgggggataagaatgcaaacgctgcaagagaagcctatgaacggacttgcgagatgtgatattttagggccggtcgcgtatatctttgacgcagcgaacacgggaagctggcggatcgaacgcccgcaggcggacgcttcgacttgcattaaatgcggtgtctgccagcgttactgcccggcggatgtcattacgattcataaggaccggccggactgtgtggaatttatgtgggattactgcaagggctgtgggatttgtgcaaatgaatgcccaaaaggctgtattcaaatggtatcggaacgaggtgacgcataatggcgcatgacaagatgctggatgggaataccgccgccgtcgaggcaattaaagcggcgcgcgtcaaggtgatctctgcgtatccaatcacaccgcagagcaccatcgccgaaaagttggccgacgcggtggcggacggggagctggacgcgaactatgtgcgcgtggaatcggagcattccgccctgtcagtggctttgggcgcgcagatgaccggcgtgcgcgccgccacggccaccgcttcggtagggcttgccctgatgcacgagattgtgaacgcagccgccggcgtgcgcgcgccgattgtgatgccggttgtcaaccgtgcgctggcctccccatggagcctgtggtgcgaccatcaggacagcatggcggaacgtgacagcggctggatgcagctttattgtgaaaatgtgcaggacgtctatgatttgaccatgtgcgcatatcggattgcggaggaccgtcgtgtacaactgccgtgtatggtctgtctggatggatttttcctatcgcattccatgcagaaggtccgggtcgccgaacaggctgaggcggacgcttttatcggcccttaccggcggcataacagctacatcgacccggaagatccgatgatcgtcaataatctgacctcgtcggatgaattcacggagatgcgttatcagcagagccgcggctttgctgcggccgcagaggtgatggaggaggtattcacggagtttcaggagcggttcggacgcgagcaccatgtagtcgagccttaccggctggaggatgcaaagacagtcctggtgacaatcggctcaacggcgggtacggccaaatatgtggccgaccggctgcgtgaacaggggcagcatgttggcgttttgaaaattgtttccttccgcccgttcccgtacaggcaggtggccgcgctgctcaaaaacgcagagcatgcagccgtcctggatcgcagcgccggcttgggcgcgcagggggcgcctgtctggctggaggtctgcgcggcgcttcaaagcatggagatcgatgtgtgcggctatatcggcggcctgggcgggcgcgatatcagcatggacaccatccggcatattttcgaggacatggcgcaaaaggacacacaggtatgtgaagaaccggcttggatcgatctgaaggagcatcccatgaatataaggcaggtgttaaaacatgtttgatgtcgttaagcaagcgaaggggcttgttgcgcatggggtgagcgcctgtgcgggatgcggcctggagctgatcctcagaaatgtcctggacgttttgggggaggatacggttgtcattatcccgccgggctgctccgcgcttttttgcggattcggaccggaagccggtatgaggcttggcggattccaggggaacctggagaatacggcggcgatggcggccggcgtgaaagcgggccttgaggcgcagggaaaccatcataccaccgtgctggcgttcgcgggggacggggctacggctgatatcggcctgcaatctttttcaggaatggtggagcgcggggaccgggtgctttatatctgttatgacaatgaagcgtatatgaataccgggatccagtcctcaagttccacaccgatgggtgccagcaccacgacgactcctgccggcaagcttacgccgcgaaaagacctgattgcgattgcggtggcgcacgggattccctatgcggccagcgcatcggtggcaaatattccggatctgcgtaggaaggttcaaaaggccagggataccgcaggcccttctctgatccatgtccatgcgccttgccccacaggatggggatatccaccggccaaatcgattgaggtttgccgtgcggcaatcaataccggtgcatgggtgctttatgaagttgagggcggcaggaccacggtcaacgtaaagccgaaggagctgcgtccggttgcggattatttgaatttgcagggccgtttcaaaggtgtcccagccgatcaggtcgaacaaattcaaaagtcggtgcgggaacggtatgaggcgctggttgataaaagcgtgtaaattcaaataccaggaaccgggggcgcctttccccggttcctttttaaaatggataggaaggggcttgcaatgaaggtttataaaatcgtggccatcaatttgggaagcacttcgaccaaaatcgcctattatgaaaatgaccgctgtgtccttaaggagaacctgtcccatcaaagcagcgatttaaagggctttgcaaccgtatgggaacagtatgactacaggatggacgcgatctgcggatttttagacgctcatggaatccgggtggagaagctggatgcctttgtgacgcgcggcggacacacaaagccgctgtctgggggcgtctatcgcgtcaacgaattgatgctggagcagtcgcgcagcgaacgttatggcaatcaccccacggatttagggctgcaaatcgcctggggatttgccagatacgggccggttcccctgacagtagatccgccgaccacggatgagttcgaaccgctggcccggtacagcgggcttgcggagatgccgcgccgcagcagtttccaggtgctcaatcacagggctgttggcaaacagtttgccaaggatcagggcaaggactacagggcgcttaatttaatcgtggcacatatgggcggcggtatcactgtagcggcgcataaaaaaggacgcctggtggatgcgaataacggcatcgcaggggacgggccgttttcaacaaaccgcacgggaacattgcctgtgggcgcgctggtggatgcctgttattccggcgcctttacatatcagcagatgatgcgcaaaataaatggggaaggcgggcttatggcttatcttggcgacgccgacgcatatcgtgcggaacaggaggccgccaagggcagccaaaaacaccgggaggcgctggaagcgatgtgttaccagacctccaaggagattgccgcctgtgcggcggtgctctgcggcgaagtggatgcgattatcataaccggcgggatggcgcattccttgatgatgatggattggattcgcaggcgtgtggaattcatcgcgccggttgcgctgtatccgggcgagtacgagatgcagtcgttggccctgagcgcctatgacgcgctgcgcggcatggagcggatcaaggaactggtttgagggaggggcggacaatgtttaaaagttttcaggagattgaacatgctgtattggatagcgccaagcgcgcgcggatcgcattggcgggggcgcacgaccttgacgcgctctcgtctctggtacgggcgcgcgaagctgggattgcgcatgggattttgatcggccggacagagcaggtcagggagattctaaagcgccttggacagcttgaaacggactgggagctgatcgaggaaccggatgccgcacaggccgccgcccgtgcatgcaggctggtgaaggccggggaagccgatatcccaatgaagggcatcatgcaaaccgcagacttcatgcgggcgattttggacaaatccaacgggtttgtactggaaaaacagcttttgagccaggccacagtttttgaattccagggccgtctgatggtggcgagcgattgcgcagtcaatattgccccggaatatcccgataaggttaaaattatgaagaatgcggttgatctggcgcgcaggttgggatgcgttcagccgaaggtagcggttctcgcaccggttgagatggtcaacccagcgatgatatccactgtggaagccgcgatgctcagtaaggcctccgagcgcgggcagattaaaaactgcattgtggacggtccgctggcgctggataacgccctgtcgaaagaggccgcgcgccataaggggattgctggcccgatagcgggggaagcagacgtattgatcctgccggatctcgcttccggcaatatattcacaaaatcattgacctatgtggcggggcttcctacggcgggcgtcctgaacgggacaaccgtccccgtgattatgacttcccgtaccgaccgcgcgcaggataaataccacgctgttttaattgctgttatgcaggcggtttcatgatggccgggctgcatggaacagatcgcgtatctgcgcatcctgccggcagggtacgcaggacgactagccgggcgtttacagagcttgccgccggcgcggcgatttgtacggccgtttggctgctgccgatacctggtcttatgccggatgggaaaaagtgccttgcgatgagcctgtgcgccgtctgctggtgggcgactggcgcgatgcatcccggatataccgctctggcgcttctggccggctacacgctttttctggacagcgagcttgtgcctgccgccacggtgttcgggctttggacgacccccacgatgtatcttgtggtcggaggctttctgattgcgaaggctgtagaggcgtccggccttggccggcgcgcggcgttggcgtttatcagccgttttacgcgttcctatggaggcatggtattttcctgttacctacttgggcttcttttgagctttgtgattccgcatccatggccgcggtcgtttctgctgctttccgtgatgtcgcatgcggcgcgctctgcggggctttcacagaaggcggcggccaatttgaaacttgctgtctttgttgcttcggttccggcttcaatgattctgctcaccggcgacagcacgctcaatccacttatcggtggttttgcaggcacgacggtttcctggctgcaatggcttgtctatatggggcccccgggactgctggccctggcgctgactgggacggtccagctcttgagctacaggcagcgcgaggcgttccaattggatctcgtgcaggtgcgcagccagcttgcggacttgggaaagctgacccggccggaaatgcgtgtgattgcagtaatggcggcggccgtcctgttttggataacagattccctgcacggacttcatcctggatggatagccttaatcgcggcgctttcgtttgcagtgccgccgcatgctctgctagatgcaaagtcctggagcggcgtaaacctcggaacgttgttttttctgtgtgcggcgctggccattggttcgattggaaaggcggtcggtatgaatgtatggctggcggaactgatcattccgcagcagacggtccgcagcccttatctgtttgcattgctggccatgctgatctgtatggcgcttcatatggcgttaggcagtgcattggctgtattgggaatcgcgtgtccggcaattatttcattcggtacagccgctggtatagctcctctggccgccgccctgatcgcttacacatctgtttcgctgcattggctgctcccttttcaccatatgaatcttttggtgggttgtggtgatgatggaggcggatttgaaaaaaaggatgtgctgcgtcttggcgttccacagacagcagtggtcgcggccgttgttttatttgaagtgttctggtgggatatcatcgggatcttttaataggctccccggtttcaactggttgaaatcgggggcttttatttgtaagtctgtgtgcctgatatcgggattatgccaacggagattgtaaatgaatgaaattcatgatatgataatattatgagaaaattatgtggaaaaggaggggcgggatgctggtatatctggcggtactggagacagagcaggaaaaaacaaaattcgaacagctatatttgacctatcgtcaaacgatgttctatgtagccaacagtgtcctgcatgatacccagctcgcagaggatgcggtgcatcaggcgtttctgcggattatggaccacatggggaatatttcaaagatcgagtgtccccaaacgaaaagctttgtggttattatagtaaagaacattgcgatcaatttgtataaccgccgaaaaaaacaggctgtcctttcgtttgacgagcttgcggactggtcagtggagcgtatcgcctcgccgggcaatgaaattgaatcgcgtgaggaatatgactgcttgatcgagctaatcggccagatgccggaaagctatcgcagtgtgttgcttttgaaatatgataacggctattcgacagcggaaattgcgtcgatgctgaatttgacagaggagaatgttaaaaagcgtatccagcgcgcacgtaaaaagctggagcagattctggacacagagggggtgaacatatgaggcttgacgacgaccttttgacacgggcgctgcgggaatcgcgagatcgcacattgtctgagtgtccgccggccggtgagccggagcatgtgttctccgaagattttgagcggcagatgtgtgctttgatacgttcgcagcagcgttttacatggcgaaagcatttgcgtgctgccgcacgcagagcggctgtttttgtactggccgcgtttgtggggctttcggcatgtatgttaagcgtcgatgcctggcgtgataagctctatgaaatggtggaggaaaagcatcctgaatattccaacatttcctatcgccctgtggacggatcagagatggacagtcagccggattttaagctgatcgaataccgtccatcctatcttccggacggatatttcctcacttcacaaatgctggatgaatacgtcaattggtcgacatatgaaagccctgacggcggttttatttcgtttgaccaagccatcatcggtgtacctggcgtagcaattaatacagagggcgcgcaactggagaaatttgatctgaacggtgaaactgcttacaaaatggataacaagggcagccagtttgtcctctggaacgacagtcgctaccagtatatggtgattacacagaatatgccgatggaggaagcggtacgtatcgccgaaagtgtgacggtttgcccggcagacgcgccgcatccgccgcagttgacacctaaatttggtccgccgcttgactatccaaaggatcaggctgccgcgaatggcgatattgtgatcagcggcggagaaatcgaaaatctaagccgtctgaacgcgttctttgatgagatggcttcccaaaaacagacgattatccgcgtaaccgattatgatcagggggggccgcgtatccttgaactctatttcaatggtctgcgtgtggattgtaccgaggacgatacccgcacgccagggaaacctaaaaatacaacgagcggatatacttatgaacgtatggaacgtgtggtgcaggacggagatattgttgtactggcggaggatcgaaacggcgggcagatggagctgttccgatatagacagccggagtgacggggggaaaaataatgcatacaggcagaaaatatttaatcgcgggagcggcgttttcgctgctcctgcttttgtccgctgcaatgacaatggtttctgcacagcggattaccgcagaaaagccaaaagagaaggagcagcttccgtcactgacgcttgtttatgaagccgaacgcgtaacggctgcctgcgacggttatgaatgggaatttatggacggttcgattgaggtaagcgatgcgcggcacccgctggatgctgccctgcgcatgccgtcaattatacggcgcgcagatgaaggccgtatcagacttatattttcagagaagccgcgcatggtcgagattcggcgatgggagctttcagagcgcggtaattatgatgcccgcgccgttacccgcagcataacggataactggatcagtgttccatcggaagggtcctatatctatgaggtaaaggcatcatggccgcgcggggagatttcatatgtttttgaatttgggcttgcgccggaggatatccggttggagcttggagatttgccggctaactataccgtggataccgctgtgaccagcggcgatgttgtgattgctccatatggacatatatggaatgaggatcgcctgtatgcatttattgaaaagacaaatataggtgcgccgggttttataagaattgctgtttttgaggagaacgacgggccgtatctgtatgatcttgattttgacggggcgcgtatcgtctgtgaaagcgacaacacgcgcgtgaagcttgtggcagccgcgcagcgcggtatatcgcgccggacctatgattacattgcggtcgaggagcagtacagcaagcaatatggttacagccttgcttatatccgcctcgcgtcgggaacgggcgcgaagatgacagttgcacagtttatgcccgtatcaatggaaacggagcaggcgcagtacagtgaagggacggagcgcctgaaggtttcgattgaaaatcataccggcggtgagatgacgtatggcgcggctttcgcgcttgaattgttggaggacggctcatggacacccgtggtgtttgacgcgcccttcgacgactgggaggagacggttgtgccgggaggtatggcggcctgtgaggtgcccctgtctgctgtcggtgattggctgatgccgggggactatcgtgttgtaaagctagtcagtattcgtcaaagagatgccgtacgcacattgcgcatgtccgcgccgttttccattgcggcggcgggtgagccgcttcagttaagacggccccaacagattggcgtattcatagggaatggggaatatatggccgccgcgacattaacagcgcgtctgcgatatgatggtcagtcctctataggatttttgatggatcagcttggaaattttcgcgcgcttccatccgattgggaaatgaaaagttcggttcagacagccggcggtattttgacattcgcgttcagtgatcaaacggagcagaagctttacctggaaccgcaggtgaaccgcatcatggaggacggctctgtggtgccattgacggtacttacaaacggtgaacgccgatattatgctgatgcggacgcttatgatcggattttggaatgcacggccgccgcaggaggcagggcgcagcctcaataatagcatcatagatatgatttctttttttacagccgtcagctttgctgacggctgttttgcaatttcaacgaagatatggtacaatttttataaaatgcattgaaattcatagcaagagcttacagttttttgcctgcctgcccgtgccgcaggcaggaatgttttgcctgaaaaggccgcgggccggtttttttagaacaaattgcaaatgttgtaaaactgaagtggaggggttttatgaacttgattgcggcaattcaatcatttgtgcctggctgcgcacaggaagcagccgatcaggatttgattctttcgctcgcactgcgcgagccgattgctgttttaacacgggagagccttgcggcgcatatgacggcatctggtttcattgtcaatgaagcgcgcaacaaaactctgatggttcatcacaatatttataacagttggtcatggacaggaggccatgcggatggggacagcgatttattggccgtggcattgcgtgaagcgcgtgaggagacaggaatcgtcaatgtggcgccgctttcccgggaaatcatgtcgctcgatgtactgacagtcccagggcacgtcaagaatggagtgtatgtgtcggcgcatttgcatctgtcggcggcctatttgctcattgcatcggaaaaacagacgatctctgcgcagcctgatgaaaacagcggcgtccaatggatcgcgtttgacagtttggagcggatgtgtaatgaggcgcatatgctgcctgtctatcggaagctgatcgagaggatgcagaagttggtatgagccgcttggagccaatagtggagccgctgctcgcctggtatgaaaaaaatgctcgcgacctgccatggcgccatggtgtgacgccttatcgtgtgtggatttcagagatcatgcttcagcaaacgcgtgtagaagctgttaagggatattttgagcggtttatgcaggcgcttccggatgtggagtcgctgtcgtcggttgaagaaaaacgtcttctaaagctctgggagggattgggctattacagccgcgcgcgcaatttaaagcgcgccgccgcgttgattatggagcgatatggcggcgcactgccgcgatcccgggacgaactgctcaagctgcctggcattggtccatatacggccggtgcgattgcgtcgatcgcatatgggctggcagagccggcggtcgatggcaatgtgctgcgcgtactcacacgtttggaggatgatcacagcgatattgcggatgcagcggtcaagcgcgcggttgaaaagaaactgcgcgcagtgatcccgcaggggcgcgccggagcgtttaattcgtcaataatggagctgggggcgacaatctgcggtccgaatggtccgccggaatgtttatgctgtccgcttcgcccgctgtgtataggatatgcgaacgggacggcaggcgatttgccggtcaaggcggctaaaaaaccgcgtcggattgaggagcgtacagttcttgtcctgacgcgcgatgcgcttttggctgtgcggcggcgcccagcgcgcgggcttttggcggggatgtgggagctgccgtctgttgaaggccgtttggacgacacaaaggtgatcgaagcagtccgcgggtttgggttggcgccgctgcgcatagcgccgcttggagatgcaaagcatattttcacacatgttgaatggcatatgaccggatggcgcgttacagttgaggagccgctggaaaaagaggggcttgagtggattgacccgcgccggttacagagcgattacccgttgccttcggcttttcgggcttatcttacgttgtgggaacaactgtaaatttgatgagggccattcataatttcgcaataaatttttgttataattaatacaattaccatatgatatagtggggaattcgttctgtttgaagtatgggccatgctggagaggctttagcctggatgttggtgttatggaaaatgaatataaaaaagaacaggtgaaagggagtgtttgcttatgtcggccaatccgttttctgagatcacgcaggaaattcttgatcttgcaaagctcagccaaaagaacagcgccattgatcccgcgctttatgaaaagctggatgtcaaacgtggactgcgcgacataaacggaaaaggggttctggctggtttgacggagatttcagatatccagtcaaccacgacggacgaaaccggttctattattccgtgtgaaggacagttgttttaccacggcatcaacattaaggatttggtcaatggatttatcactgagaaaagatttggatttgaagaagctacttatcttctgctgtttggccagttgccaacagaggtacagttaaagaactttacggatcttttggcgcgttaccggacccttccgacaagctttgtgcgtgatattattatgaaagcgccgagccgtgatatgatgaacacgcttgcgcgcagtgttttgacgctttattcctatgacgaccgtgctgatgatatcagtatcccgaatgttctgcgtcaatgcctgcaattgatcgctttgttcccaatgttgtctgtgtacggctaccaggcatataatcattaccacgagggacagagcctgtacatacacgcgccggacccggcgctttccactgcggagaatctgctgcgcattctgcggcctgacagctcctacagcgcgcttgaagcgcgggtgcttgacgtcgcgcttgtgcttcacgcggagcatggcggcggcaataactcgacctttacaacacatgtcgtttcgtcttcagcgacagatacatattcaacaatcgccgctgcgatcggttcgctgaaaggtccccggcatggcggtgcgaacatcaaagtggtgcgtatgttcgaagatatgaaagcgacgctggatgattggaccgatgagagccaggtgcgtgagtatctgcgtgctctgctcaataagaaggcgtttgatcatgcgggtctgatctatggcatgggccatgccgtttattccctgtccgatccgcgcgctgatattttccgaaaatttgtcaagtcgctttcagaggaaaaaggcctctatcgcgaatatcagctttattcgctggttgagcgtcttgccccagaggtaatcggcgaggagcgccgaatctacaagggcgtttccgcgaacgtcgacttttacagcggctttgtttacagcatgctcaatcttccgactgaacttttcacgccgatttttgcgattgcgcgtatttcgggctggagcgcccatcgtctggaggagcttgccaacgctggaaagatcatccgtccggcctatggcagcgtcgcgccgcgtgtcgattatgttccgctccatcaacgtggataagtctattcacacgaaagtagtgatcattgatgtttcgaaagagttttcaaattgaactggaggattctttgacttatccatccgcgcgaatcatttgtgaagctgtcgaatcatatgctgccggtagtaaggagcggctgacatttgtcagccgtgaaatgcccgtctcgttctatctcgatcaggatttatacgaggtaaagatcattatgatacggggcggctatgagctgtcatgcaggaaaagaagataaaaggaggtcccggccagccgggacctccttttatcttaaaagatattggacaggttcggaatttcggaatcgcgtatatgactgatcagcttgcgcaggcggtcgacttcggcagcgtactccgccttcgccccatactgtgcgagcgcggggagccgtgcgaccacgccattgatcatgtccaattcgtcgtggtggatatatcgtgtcatgacagcttcattttttttccatgcgctggaaaactgatctgcaatactggctgcgtcctccagatcgtcccggtcaatcgcttgtgcaacctctgagagcatttggtccatttcatcagatacacgaatcagatgcaccagagagccgacgccagtggcgataataccaaccatgatgaaacaaacgatcacaattcgtttcatgcggaagcctcctttttgacaggcgcctttttttccttggggacgatcaaataatcggcttgacggttacaggtcatcagaaagatatcgttaatgacatagtgatgatcggtgacagttttttcaagccattcatagcggaggttgcagtaatcaagcgcgctgtcgatcacaacgccgtcagcgatcagaacaacgggcggcgcgtcatctccgggcgacggtttgagcttgagcatttcagcagtgacaggctgtgcctgaaatttgggataaacagatagtgtgcctgttgtttctacgatggcgaaggctacgtctcggatatcaaaaatatctttgccccttaattcctccatcatatcgtcgattgtaaaacgcagttcttttagctgctgttggtcgatttttccgtcacggatgattacacgcggcgttccggatacgagacgccgcatttttttataacgaagcgtaagggcggaaataataacgtcgaaggaaacgagcgtcagaattggtatgatgccgctgacaagcgggacattattgtcctcaatagccatagtggcgatgtttgaaacaaggattgtaacgacaagctcggagggctgcaattgaccgatttgccgtttgcccatcagacgcaggctgacaatgattaatgcgtaaatcagcaatactcgaaaaaatacaatcaacaaagatatcagtcctcctggatttcaatacaaaatttagtctagccataacacctttggatattcccggcgaataaatggcaataatagagtgtgtttgtaggtttcgcacaccaggaaggaatgataacatgggcatctggaattttttgaaaagccggccgcagccgcctgcggaagcgtatgcgccgccgcggacggacagtgcggcggaccgaaagatggaccgcgtgcttttgcagcggttaatagatattcgtgcgttatgtggtggtacaggcgatctgattgtccacgagcttgaggtcagcggcgtttcgtgtgctgtggtgctatgtgaaggcatggttgatacaaatacattttcaaagatgtttgcgcttccgctgacttccctctcgctttcggatgcgtcgccgcaggctgtccttacatgggtgcgtaaacacgcgttgcttgcacccgaccaaaaggaaatttatacgtattcagagctttttcgttttattatgtccggctttgttgtcctgttgatagacggcgtagaaccagggattgtttttggcatccagggatataccggacgctccgtatccgaaccgtcgggagagacgaatgaacgcggctcgcgtgaaggatttattgaaaaactgcgcccgaatatttcaatggtgcggcggcgctttaaatcacccgacctgatgtttgagatgattacatttggagaaaaaagccgcacggatgccgcgcttgtctatcttcgggggactgtcgcccccgaactgctgcgcaaggttaaagagcggctgtcaaaaatacgcattgacgttgtgcttgaaagcggttatattcaaccgtttctggacgcgaagccgttgtcgcttttttcgggcgttggatatacagaacggcctgacacactctgcgccaaagttgcggaagggcgtatcgggctgattgtcgatggtacgccatatgccttgatcgtaccatatttattcaatgaacactttcaaagccttgacgattacgcgcatcggccatattatgcaacctttatacgctggctcaaatatgccgcatttttcttttccatttttctgccaggcttttatgtggcgattggctcttttcacccggaacttctgccagccacgttgttgaacagcctgatcgtcagtgaggagacaacgccgtttccattaatgtttgaagctttggtaatcttttttatctacgagattatgcgcgaagcagggcttcgcatgccgcagtcggtcggacacgcagtcagcattgtaggtgcgcttgtcatcggtgacgccgccgtcagcgcgggaattatcggcactccgatggttatcgtcgtagctgtaactgcgatcagttcgtttgttgtaccgacgctttatgaaccaattacgatcctgcgttttgcgtttattctgattggcggtatgtttggaatttttggaatatcagcagcattttttgccgtagcggctaacctgtgcgcggtcaatccgctggggataccagccactactccggcaacgccgttttcgctctactccatgcgcgacgtgttatttcgctggggatggaaaacgcttgcacaggaggatctgcgcgttcagggactgaccggcagcgatatcagcacacaggggggaaaaaacaatgcggacaaagccacatgatatttctgccgggcagttgatcatgatgcttgttttatgcagcatcttcacgatgttctcctatacctcaggaacgagggaaacactttctgcaccggcagcgccgctggtacttttgttgtcgtcagccggcgcgctggtcgtgatcattccgtttttccttctgaaaaaacatgccggcccggatttattgacggctgcctatcgtgcgggtcgtccggtcggcacggtgacatcggcgctgtttggattattttgcatctatatggcagctcaaacaactgcctatttcgttttcctcatgatcagtacggtttatcaaaatgcgccgccgtggatttttatttttatagttatttttctgctcacggcaggatatgccgcgtcgcttggattggagtcaattgcaaggttcagcgcgtttttgtttgcgctgacaatgattgtcgggcttctgatcctgggatcactgatccctgaatttgagctggtccgcgtcgcctggcccctggtggacggacccgagccggttatacccggtacaatccgtgttctggcatcgaacgcagaaattcttttgttcattctgcttgtgccgcgtatcagccgtggggccggaaaagcatatatatggtgggtggttttgtcgctggccgtctgcatggtgctgacaatatttttgatcgctgcgcttggcggattcgctgcgacccgcctctttccgcttcaaacggctgcggccgttgcgcgcgtctctttgttcgggcgtatggatttgtttcatattctgacatggacaggtatatcgtttttacgtgcttcggcttatctttattgcggatatacctgccttcggcgtatggcgccgaagctttccgttggatttggcgcgttgatctgtgctgttgcggctggtatcatcgcgattttgacggtacaaaaaatgcgtctttgggatgaagcaggcaatcgtatgattctgatcataccgcttgtgatgcttgccgtacttctgccgctgtgcctgttgccgctgaggcgcacacttgcaccgcaaaagcagacaggcaaaaaggagggggcgtcatgagaagaatagcggctttgatgcttgcgcttgtaatgctgaccggctgcgtgcagagtgtgaagctcaatgagcggggcgtcgtgcagacgataggaattgatttgaatgaagatggattttatcgtgtgacattgcaggtacgggaggcggtcgggacatccggagcgcccaaccagcctgacgaaagcagcaaaagtatcgttgtagaggagacaggcaggaccttgacggaggtatttacgcgagcctcagtgacgcagggccgtcagatgtttttgggcagtgtacagataattgtcctgggggaggaaacggttgcagcgggaatcgacggcatccttgattttttcaattccaaccatcagatttcaccaacgacagcaatcgtagtggcgcgcggtgaggctggggaactggttcaggcggggcgcgatgatccggcactttcggcggatgggctgctcgatgtaatgcaaagcgcatataaaagcggcttggctcccaaaagccgcatgatcgatttgataaatgcagtccgtggggaaccgcctgttgccggaactttggcactgatcgaatatgttccgacgtcacagagtgatcagaagccgcaaaccccagaggaaccgctcccggaggcgttattttctcaggacaacgggcagacgtctcaaaaagaaccggaggaggatgagtcatctggcggacaggattcatccgaagggggagaagcggcaaagaactcctccagagaacaggaggagaagcgcctgcggctgtccggcagtgcaatgtttgatggcgaagaacttgtgggttttctcaatcctgcggctacacgcggtttggaatggatgcgcaaggatatgaaaaacgctacggtaacagtcggagatgaccggatcggaagggtggctgctgttacacatgatcaaaaaacaaagataaaggttgatttgacaggcgatgtgcctgtatttaacatcgatgtgacagtgcgcagtacggcgcttgaaaaacaattgccggacagcctgctgtttgatgaacaggcgcgtatttatacagcggccctccaggagcatctgattcgtggagagatcgaggcggcggtgcttgatgcacagcgtgaaggtcatgatgttatggggttgtcgctgctaatgcgacagaggtaccccgatttttacaaagcgcatgaagcagattggtcaaaggtgattgcaacggcaggttacaacatttttgtacattgtaccatcgacagtaccggggtcgaagcgtgagtatggcgtcgtagtattaaaaatcataatgggccgcgcgccgcgcggcccattatggtcagctatcgctgtacgcttgggacagagatgatacggaaaggcttgccgtgctcgacgcagacgcgcaatgtatatgctgtgccgcgtgaatggccatcccagaaagcaagcacaagatctgcgtaatcgacaatcctgctgttgcgaattaaaggcgcaagacgcccattcgcttcatagtccgggcgaaatacggtcattggaagtccaagcctgcgggccgcgtcctccgccatcgcatcaattcccgccgcgccgccgctgacaagctcggaggtattgagcgggatatgcctgataagatcatccgtaccaaatggtccaatttcacgtgaaccgataattgccacccgcatccctgacaccgccttttaaaaaatcgttccaaaaattctggatgcttttattataacatgcaaggaaatcgttcgccagattgaacaatgaaaatatgggatggccgttgcggcgggcttttgcagacctttaaattttgtttgaaaattttaatgaagttattccccgcaataatcagattatccggtggaacagtagacacgtaacttaaaaaattgtagggggatcataccaatgagaaagcattataaacgctttgcgtgcgtgctctcggcggcaatcgtcgcagtacagacgctggcgctctatacacagtccatcctgccggatcattattatgttgcggcgggtgaaacacttacaatcaattctgctctgccgattacttcccaggccagccgcggcagtatgccggtagaagtctattcggctgcaggcaacagctataatgttgatctgcgcctgccatacggcgttgaaatcaaacaggtgcaggtgcaggttgtcgaccgtgaaatggtagttccaggcggcacgccgtttggaatcaaaatgtttaccgagggagtaatcgtcgttggtatgagcgatattgcaagtggaggcacttcatcgaacccagccaaaacggccggcgtgcgtgtcggtgacatcattacggcaatggatggcaacacagttcaaacaaatgaggatgtgggaaggattgtaatggccagcaaaggcaatccggtacgcattgatttggagcgcaatggcgaaccgatgacgtgtcaaatgcagcctgttaagagcgatgacggtgtttatcgggcaggtatatgggttcgtgattcatcggctggtattggaacgctcacatattataatccatcgacagatgtgtttgctggacttggccatgcgatttgtgacattgacacaggagacatcatgccactgcattctggtgaaattgttgacgtaaccattaccggtgtgcatcgaggcacaagcggttcgccgggtgaactgcgtgggagctttacaggtgacacaacaggggaactgctgatcaattctcaagtaggcatctttggaacgggcggacaaccggatacggctttggaacctgtcccgcttgcgcttcgttatgaagtggtggaaggtccggcgacgattctatgcacgcttgatgacaagggcccgcaggaatattcgatttccatcgaaaaagttagtattgcagaaaataatccaactaaaaatatggtgatccgcgtcacagatccgcggcttttagaaaagacaggcggtatcgttcagggtatgagcggcagcccgatcctgcaaggcggtaagcttgtcggtgccgttacacatgttttcgtcaacgatccgactcgaggatacggtatctttgcggaaaacatggagaaaatgtcatcaagcgtcgaacagcggcgaaaatgacatgagtatattacacaaataaatgctggaaagtcctctaactttctaggtcaaaattgtctaaaaaaggttgccagaatttgcaaaaagtgatactatttgtttagggaaacgcaaagaagggactatcgaaaggatgaaagaaaaggcaaaagtgctgattgcggagagtgcgggcgaatattgcgcgaaatgcgcatccttgctcaaaacatacggatttgaggcagtgatcgtaccgcgcgatggtctggctgtggttcagatggttggagagatgcgtccgaaggttgtgctgatggatgtttttatgccgcggcttgacgccataggcgtgatgaaatctgtcagggaaatgaatcttggatatgaaccacgttttatgatcacctccactttcagcaatccgatgctggagaacgaactgattactgcgggcgcctgttatttctttttgatgccgtttgatccggaggttatggttgaacgcgtcatcaagatggcggggatgccttcgggagccagccttccagggtcggaggccgtggcgggaagcgaacctgatctggaggttatggtgacggaaatcatccatcagattggcgtgcctgcgcacatcaaaggatatcactatgtacgtgaatcgatcatgctggcggtaaaaacacccgagattatcaattctgtcacaaagctgttatatccaactgtagccaagaaatatgcgacaacagcatcgcgtgttgaacgcgccatccggcatgcaattgaagtggcgtgggatcgcggcgatgtcgatacgctcaacagctactttgggtatacgattcacaacgggcgcggcaagccgaccaacagtgaatttgtcgctatgattgccgataagctgcgtctgcggctaaaaaatgctaattgattgcggcaaagtcatgctgcatacttgggtatcctttggttcaaccggttcgtcgcagttctgatgaatttgcgaaggaccggtttcccttttgaagcttagtaatggtgcgcatatcgcagcggcagacgggtaaactaagatcgacgtaacaattgggttgcgtccccgtttgcaaaaacacaagactttaaaaggaggcgttctcaaatggataactgcaaggccaacaagtgcattgaatgcaccgtaacccagtgtgcaaatcattgctccacctcgaattattgtgcgctcgactgcatcagagtcggcacgcacgaaaacaatccgtcgatggaccagtgcacagactgccagtccttccggaaaaggtaacggcgatttcaaaaaaagcacgcccgcggcgcagccgcgggcgttttctatatggcggccatcagcttttgagcaatagcgttgcttccaatggataatgatccgacggataatgcccatcaactggatccgtcataatatgggcttctacgatctcaaattcatctgaaacaaagatatagtcgattggttgagctcctggacgcacccggccgctgaaattatgaagcgtgttattaatatgcgctgggaaccttgtatacacatccgtcaaatgcagctgcggatattcatcagaacaggcgcgcagtaagcgtacagggcggcttgtcggcttggcgttgaaatcgcccatcaggatggttggcataggccgctcctcattgaaagaacgcatatagtccaggatgactcggataccaagtgtacgagcgattccacagatatggtcaagatgcgtattgaacacacgaacacaacggtccagctttgtcagatatacctccgcaaccgtacagatccgcggaaatacggcaaaataggcgcgagaaagccgttccgggctttttgacagccaaaaggtttttatcaggcgcacactggcattatcattttttatgatgatatcgctgtgttcgtcgctgtttggcttggcgccggaaaaacgtccgaatcccagcacactgtaatcgacgtcgagcaggcggctgacgtcgtcgcgcatattcggaagaagttcttggacgccgacgattgtcgctccgctttcacggataaattgtgctgccaaagcacgccgctgcccccatttgtgtgaacggttcagcgcgatcccaaagtcacgtttgagattaaaggaaaccacccgaatcaagttgtcccccatattggcatcccctttaaaaatgatcttgcttttatgataccatgttctatgacaaatgcaacgctgtaaacgaacaagaaatttttggaaccctgacttttccagcactggaaagtggggaacaggttgtaaaaaataaaagaaaatattataataaatgatagatgcggcagcctcggcgggcggcttgtccgcaggctgtgcagaaagcggtaaggagggatgtattatgaaatttatggatgtaaagtcgataggctgtacacttaaattgtcgaaaatctccaaaggcgctgatcattttggtgtaacgattccaaaagagcgtgcatttgcgctgatggatcgatatctggagcttggaggtaatgtgatcgatacagcgcgcctttatggccgtgcgcggccatttgacgccgaatttgcgcacagcgaaccgattgtgggggagtggctgcgtacccggagaaatcgcgatcaggtgatccttgtaacaaaaggcgcccatcctgtgatagaggatatttcaaaacggcgtgtgaatcctgaatgcattgccgatgacttggagatgtcgctgaaagcactcggcgttgattatgtagatatttattttttgcatagagacgaccctgaaaagcctgtttcggaaattatggatgctttggatgagcatgtaaaggcaggaaaaatcagggcgattggcgcgtctaactggacatgcgcccgaattgacgaagccaatgcttatgcgcgtgcacatggtaagacgccttttgctatttcacaaatccagtggtgtgccgcctatgtgaaaccaaatgcctggcctgacccaaccattgtatcgatgaatgaaacagagtatgccggatacataaaaaacggcttgccagtgatggcattttctccacaggcaaacggctacttttcaaaactgattgcgggcgagcctctgaaacaaaaatacatggaacggtacgattgtccggaaaatcggcgcagacttgaacatatccgcgccttgtgtgaaaagaccggaaagtcgcccgctgcggtcagccttgcatatatcacctcaaaccgcgtaccggggtgtgcgatcattggttgttctacagtggagcagctggaggacagcatgtcggattctgatctgacgctgaccgaagccgactgcgccgcattggtatagccgcatgggaacgctgttaaaaacatctcgccggagggggagatgagagccgcggtaaagctgcgcatcggtttatggatacggcgttggtggacattgtttctgctgcccgcaggacttttattgatctggcttgcacacagttttcctgcggttacggaacaggtttattccagaatcatttatccattgatggccggttcaatcggcgcgttgacttctctttttccattttcactgtttgaaattgggttgctggcgctgctggctgctgttgcgctgttgctgttatatgggatggtgtgtctgccgcttgcattgctgcaccgtcccgcgccggtgcgcgtcgcatggaagcgcctgctgatactgctgccgaaagccgtatgcgtcatttttttcatatttgttacgacctgtggactgaattaccatcgtttggaatttgcacagacaagcggtctgcaaatccgtgattcatccgcacaggaattggcggccctttgccttgagctgtccgcgcgcgcgaatgaattgcggctggatgttggagaggatgcatcgggtgtgatgcgtctgggttctgacttttctgatacggctcacaaagcgcgcgatgcctttggaatgctcgcacaggaatatgcggtttttccaaactatgcaatcataccaaagccagtgataaattcgcgctttatgtcgcatatgcagctgacgggcgaatttacgttgtttacatttgaggctaacatcaataaagatgcgccggattattctatcccagcgacgatgtgccacgagttggcgcatacacgcggttttatgcgtgaggatgaggcgaattttatcggttatctcgcctgcattaacagtgattcgatagaatttcagtatagcggcgttatgttggctctgattcatgcaagcaatcggctgtatgagacggatcaggcgttgtaccgcgatgtggcatcaacattttccgatggtgtgcggcgggatttcgctgataataatgcatattgggcgcaatttgaaggaccggtagctgaagtatctgatgcagtaaacaatgcttatctggttatgaatcatcagagtgacggcgtcaaaagttacggacgcatggtcgacctgctgctggccgattacagaagccgccataatttgatataaaaaggcatccccttgcggggatgcctttttatatcaaatcgtttctttggaaataaattgcagatagggcattccattgatccgggccattgaaaaagacaggcgcagagtataaagcggcggctgctcaaaattgagatcttcaggtgcaaaaaaatcgatttcataggcgatgccgccgtcaggcgtgccttttggatcagctaacgcataattataactgccggcatcatggccgacagaataacgataagcgtcattgtcagcatcataatgtgtggaatctgttggagcaaacccatcaagtccaaacaaattttttgcttgctgcgcgacgatagaggatggaatcagatattcgccgctgtcattctgttcgaaatagtaacccagcatatctttttgtcgaaacgcttcaacaaggcagaaaaacagcacatcctgcgaatcaagctctgatgcggttgctgtgccttccgtaccaaaaaaactgatgaattggatcagatcggtttccagtactttttgatccgtatcgctaagttcgggaagcggatattcttcctcaggctcacttgacggtgattcggatgaggagggaagggaggaagccgccagttcttcagaagaagaaggctcgctttgagaagccggttcagaggagggctgcatattggccgcactgcgcgcctcacagccagtcatccagatggcgcaagtaaataaaccggcgcacagcgcgccgcagagaaattttttcatcagaataatacccccatggtataacggcaaaccgtcgtttgatttaaagacatgatatcatatctgcgaagcggcatgtccaaattgtccgtcaaaactgccgatcttgtatgcggcggaccagttggcagaatccagcacagtgctttgcggttattgtaccatgtgttccacaagcggtcaagcagcatcttgactgttttcggcttgcgaaaatttaagacaaaaatctcttgatcacaggcgtatttagtgatatgataataaaaatatacacctgacaagtgaacagttggctgtgaaaagcaaggaatggaggacgtatgctgaacacaaatgcaagtgaaaagtttttgaaggaaggtttgacctttgacgatgtgctgctgatcccagcgcgttcggaggtcgttccggcggacgtggagattggcactgagctggtgcgtgggatccatttgaattctccgtttttgtccgcggcgatggatacagttaccacttcgaagatggcgattgcgatggcgcgtgagggcggtatcggtatcatccacaaaaatatgagcattgaggcgcaggccgatgaaatcgatacggtcaaacgttctgaaaatggagtgattgctgatccgttttatctgtcgccggagcattttgtgtacgacgccgatgaaatcatgggtaaatataaaatttcgggcgtgccgatttgtgaaaacggtaagctggtcggcattctgacaaaccgtgacttgcgtttccttgaggattacagcatcaaaatcaaggaggtcatgacaaaggaccaccttgtgaccgctccagtcggcacgacacttgacgatgcacgtcagattcttcgcaagcataagattgaaaagctgccgattgtcgatgcacaagggtacctaaaggggcttatcacaatcaaggatattgaaaaagccgtccagtatccaaactcggcgcgtgataaaggcggccgtttgcttgtcggagcggcgatcggtattacacgcgactttatggatcgtgtggatatgcttgtcaaggcgcaggccgacgtgttgtctcttgattccgcgcatggccataatgttatgatttttgattgcctgcgtgagatcaagcgaaaatatcccgatattcccgttatcgccggcaatgtcgcgacggcgcaggcaactgaggatctgataaaagcgggggcggacgccgtcaaggtcggtatcggtcccggatccatttgcacaacgcgcgtggtggccggtatcggtgtcccgcagcttacggctgtctatgatgcggcatgcgccgcttcgaaatatggtattcctgtcattgccgatggcggaattaagttttccggcgatattgtcaaggcgcttgccgccggagcatctacggttatgcttggttcgctgctggcaggatgcgcagaaagtccaggtgaaacagaaatttaccagggccgcagcttcaaggtttatcgcggtatgggttctttggcggcaatgggtgagggttccagcgaccggtattttcaggattcaaaaaagaaactggttcctgaaggcgttgagggccgtgttccgtataagggaaccgttgcggataccatttaccaattgattggtggaatcaaggccggtatggggtatacgggatgcaaaacgatcgtcgacctgcacgagcgcgcgcagtttatcaggatcaccggcgcgggtcttaaagagagccatccgcatgatatttatatcacaaaggaagcgcccaattatacggtcagcccgtgatcgaccgaatgatacaaaaataatcgccggcatttgccggcgattatttcaatttatactgatatagatctactccaaatcctgtatattcatcttttccagcagttttttacgattttgtttatgctgacataaaaaatatatggaaataaggatcgccgtagggatattcataataagaaatgtttggatggcagcccaaaaaggtccgctataagaatacgattttgaaaggctcagaattgccagcagggaattgaggagcgtcagtaagggcagaatcaatcctaacaatcggttttcttttttggaaagataaatttgaagcaggatcgccccgatacaaacaaccagaacggcaatgagggggatgatcaaaataaaggtggcgattgccatggtattcactcctttgggattttcttatattcatgaatcaaaatttttgctgtatcaaaatcaagtttatcgttgactgccaaacgtttaatcagggcgatatacggttcgttttctgcatcctcactgattttaattttttgaattaatttatcaagacgcagccgtaccgtcggataagtgacgccatactgcttggcaatttccttgagcgaaccggacgccagcaaaaattttttaataaatacaaggtcttcatgatcaagattagccaaccactcgggcatgatttcaatcgccatttcaacaccttctttaataatatttattatatacttaaatattattaaagtcaatagtgaattataatttaatatatttgattatagtcgagatatcattgctctgaaaatagatttactctggaattgcagccgcagacctgttataatcattcaagggagacagggggagcgaagtatgaagattggggtcgttggccttgatgcggccggctgtatcattgcagggcatctgcttgcgaaaacagcgcatgatatttgtacatatgacccggacggcaggcgatgcggtacaattgttcggtgcgatacagcagcagaactattcgatcagtgtgagcgtattgtgatcgcgctcgccgctcctgcggagttgacggcgctttgtaatgctgtttcatcgtttctgcatactggccagattataatagatttgacggacacatcgcctgccttggcgcattccatagcaaatagaatgcgccggttcgacgtttcttatcttgattgcggtatctttggccgcaacggattgacagaaccgttttcgatgttcgtaggaggaaacggggaaagtttttcagcagttcagtcattgatcagatgttttgcgccagagtgtcggtatgtgggaccttcgggacgtggacaggccatgcgtattatttgccgggcgcttgcatcaaagctgatgtgcagcatcaaagacatggaggcgttggccgcatcgttcggtgtcggcagatctgcctttatcgatttgctcggttcatttgaggaaatcgctgtgccgctggcggagcttgaaggaaaaataccgccgtttgactataaagaattgttacgcgatgcattccttgcggatgaaatggcgcgccgtgccggcttgcatgttgacgaccattaggttatacgtcaaattgtttcgataaacagatacaatatgaaccttttctggcttttggaagaaccctattgatatttttctcggcacgtgatacaataatcatatactatttttgtttaaaaggagctgctaagatgaaactcagcgcgcgaaatcagcttaaaggaaccattatcgatatccaggaaggtgcggtcaatggaattgtcaagatcgatattggcggcggaaatataattagttctactatttccatgaacgcgattaaagagcttggacttacggttggaaaaaccgcctatgctgttattaaagcgacttctgtaatggtcggagtcgatgaataaaaatattggcattgacctaagatgaaggccgcccccttttttgaggggacggccttcatcattataccgcttgcatctgtgcgtattgcgcacggcctaatacgaataaatctgcgcccatgcaatcgactgcaacaatcaggggaaagtccgaaacggtcagctttttaatcgattcacatcccagatcattataagcaatgacctcgcagcgtttgatacactgtgcggcaagcgcccccgcgccgccgatcgaacaaaagtaaacgccctgattgcgcacaatagattcgcatacggcctgactgcgcgctcccttaccgatggtcgcaaccaaaccgcaatccataagagtcggagtataggggtccatacggcctgatgtggtcggcccgcaggatccgattgccataccggccggcgcgggggttggaccggcaaaatagatgcaagcaccctccaaggggaacgggagagattttcccgcattcagagacgccatcatacgtttatgagctgcgtcgcgcgctgtgtaaatttccccggaaagcaggacttggtcgcccgctcgcagcataggcgcaagacgccttaattcttttgcatcaatctgccacgttttcatccgtctgacctccaagatatccggcttcgccgtcaggcagggtaaacggctcgctctcatctgtcgtataatcgagacgaacggcatccgtgtcgaaacgcttctccacttgacgcacaatctcctgcataacatcgacacgatcgttcaatacgaacagaatttcttcgatcgatttgcgcaggcgcgaggcgtcgcccttgaagcttgaaagctcggaatgaaagccctgcatctgatggcgcgcttccgcaacaatctgggccgcgcttgtacgcgcatcggctatgatttgatcggcattgcgccgtgcctcaatcatcgcatccccgatctggccggaaacttcatcatactttttacttttgtaatcaaggctttccaccttgaattggagttggcggctgcgttcaatttgaatttgtaattcccgttcactgtcggaaagctgctttttcaaattctgattttgcgcgtcaaggtcggtgatcatagtctgagcctgccgagctatttcgcgttctttttcaagctgctcggctacagcagtcaatttaccgtcctgttcggcaagctgtgcctccagccttttgatatgagcaacctgtgactcctgcgcacggctgtattccgcaagcctgctctcatagtcggcttcggctgcattcattttttcatttaacgtatctatgtagctaagcacggattttttatcaaatccgccaaacgcggctgtcttgaacccgttttcttccatttcgaggcatcctttcgaccgttgaattcgcccgttacagacgctgtggcctggtggtttatatgtactataagtataccattattcccgaaaaaaacaaaggaaaatttttaaaggttgcacaatatgattcctgatggttgtatgatatacttaaaaacagttgttttacaagtgctttgcagcatatgcccgctctgcgggcaggcgcatattaatcaaactgcccgcgctggggacagcgcggatggctaatttttatagtttgcaaagcgaaatctataaaaaatagtgtgggtgctataatattgctatacaaagggacaactttgaagttggtggagggattatggatattgtattagcttatgggagagaacttgatatgcttggcttagtgaccgaatatacaaacggaatactggaacaaggtacggatgttgttcaatgccttaattctcaacacttggatgatgaattaaaggatatgaatttgaaatatgctctgccccacggacgaatgtatcttgctcttgttgatgataaagcagttgggtgtgtcgcgttaacaaaaaatgatgatgtgtattgtgaaatcaaaaggttgtatctcaaacctgagtatagaggaatgggcatcagcaaggctcttgttgaaacagttataaaggacgcaaaggaaataggttacaaacacatgagattggacacttttccatttatggcatctgcaataaagttgtatgaaaaatacggattttattacattgaaagatataatgacaatcctgcggaaacagcaatttttatgcagtgtgacttgtaatgcaatgttcactttcagtttgatgtgggtttgggatattcccaacaagcaaaaaaccctctttctgtcgcagacggaaatgagcgatttttacggaaagggtacctctttcctatgcttgctacggaacttttcatagagaaatgtaagggaaaggacaccctaaataagtagtattctctttgaagtgttgcgcagttaaagcgcatttttgtggaaaaaggtataaacaccttaccctatcagttttagtgcttgtaatgcctttcctacaaggcttattaagcctctaatgcgtaacataagagtgcaaacaaagccgcccttttgggcgcaataacaccgacttgtatttgtatttattgccttatttgtggtgctaaaatggtgcccaactttacaaaaccaacttatacggcgatatgggaagatacccgcagaaacgggaaaaccattgaaaatacagggtttttccacacttttataaacacttgtaaggagttataagacgattttcgtctataaaatcaataaaaaataatgcggtgtttggaggatttacgatatggaaaaattgatagccttcgatttggacggaacactgagccgttcagacctgttcctgctgcccgcttatcgaacggctctgacaaaaatgggacggccggttttgtcggatgaggtgcttttgaccatgattggaggtacaaccttggacaacgcccagattatttcggcaggcgatatggaggattatggtatctttaacaattatgtacggcaagagcttgcggcgcatatgtcaaccgatgcccgcgcctatcccggaattgcacagagcataaaagcgctgcgggcgtgcggctgccggattgtactttgttcgaatgcaatggcgcattactcacgcccgcttcttgagtcaattggtttgctcgatctgttccacgatatcccgcaaagccggccgggatgggataagcagcatcttttgaaatcaatccttgaaacctaccggcccaaagctgctgtgatggtaggggaccggcactttgacatagaggcggcacgtgcggttggcatcccagtgatcggctgtggttatggtcttgcgccttcggaagtcacaggggctgatattgtcatttcagatgcttcagagctgccggatgcagtaaaacgccttttgggagtttaaagcaggaagattgatggaaaaagccgtatcgagacctttttgcaagcagcagcgtctgcaaggcaaaaaccatagggataggggatgtgttctgaatttttaacacagcagacgccgccgcttacaaaaaaagacggtatttttgattactttaacagcccctctaagcatgttcaggcatataatcggatggcggctcagaagtggagaggtggcggacaagcataacaacgacaggtgcggccaacatgccggcaaagccggcaattttaagtccggcatacatggatgtaattgtaacaattggatgcagcccgatctgcccgccgacaatgcgcggttccagaatattgcgcagcacttcaatgacgccaaacagcaaaagcaggccgatccctccgagcatatcgccgcctgcgatcagtgcggctccccaagggacgagaatggttcctgtgccgacaagaggcaaaatatcaagcatggcgatcacagcggcgactggcagcacatagtcgaagccgagcagtccaagaccaagagacagctcgacgaatgtgatggcaagcagaatgatataggcccgtacaagcttccagattgtttcgcgaagaaaacgctgtgtttcacgcacgcgcggctgccagcgcttgggaaccaacgaacagatcgccgcgccgacagcgcggtagttcgcggctgtcagaatggaaacgacaattgaaaacacggcagtgatcagaagcatcggcagctttgcggcgacgcccgccgcgattgtgaccagatgcgccgagccgtcgacagcggcctgccgtacagcatcggatacggcctgtgaaaagcgttccaaaccttcctcggcgcccggatcaaatcggcctgccagtccgtaaaaccacccggccaggcggtcaagcaacggggcaatattctgggtgtacagcacgggcagccggtcgagaagttcgtaaagctgcgcgagcagaattgtcaaaaacagtccaagcagcgcggctgcaagcagataaaaaaacaagaggctgatgatggccgcacttttttcgccaaggcgcgtcttttttgtgagtgtgagggcggcgggccgtgtgagggcggcaatcgcaagtccaaagaacagaggaagcgtccagacgagaagataccgcaccagaaaataaagcagtccgccgattgaggcccagtatgcgattgtcagtacagtctgaaattttgtttcattcatgcgcttcaccccgctttccatgaaaatagtatgcgggaaagcgtgcaaaaaacaccggtgacggcgctatgaaaaacattggcaaacgaccgctgtgtttggcaaaatggtttccagtgtcaggctttgcagaatgggcaatatcgacaatctatgtgttgtttcagaataattctattgcaaagtgacggtttactttctgtcgcaggtatggtatattgtatttgtgtgaaatacaaaagtatttgaaaggtggacgttgatggaggaagtaaatttcctgcttgttgacgcaaaggtgctgccagacgtgtttttaaaagtagtggacgcaaaaatgctgttggcgcagggcaaggctaaaagttcgtcgcaggcggcacagatggccggtatatcgcgcagtgcattttacaagtacaaggacgcgatctatctttatgacgaacgcatgagcgaaaatatcacaacgctttatctgacgcttgaggaccgtccgggcgtgctttcgcttctgctcagcgagttgtatcgggcgggagcgaatatcattaccgttaaccaaaatattccggttgatggtgtggcgcttgtatctgtttctgtgcgcacaggagcttcgagccgttcgcgcagtgaaattttggatatgctgggcgcgcttgacggtgtcgttgaagcgaaagcgatttaaaataccaggagcatttgattaaaaaatagcagatggaggattcgcaatgattcaatttgcggttttagggtatggtacggttggttccggagtcgtggaagtatttttccgcaacagggaatctcttgaaaaaaaagccggcgtaccgctcggcttaaagtatatccttgacgtgcgtgaatttccggatagcccctataaggatttgtttgtaaaggactttgatacgatcttaaacgatgattcggtcggtgtggttgctgaagtgattggaggtgtggagccggcgctcacttttacaaaggcctgtctggagcgtggaaaaagcgtcgtcacttctaataaggagcttgtcgcgcagcatggcgcggagctattggcaatcgcacgcgcaaataatgtcaattatctgtttgaggcaagcgtcggcggcggtattccgattatccgtccgcttcattcctgtctggcagccaaccggatcgaggaagtgatcggtattctcaacgggacgacaaactttattttgacgaagatgttccgtgagggaatgtcctttgaatccgcactcgcgctcgcacagcgccttggttacgctgagcgcgatccggccgctgatgtggaagggcacgacgcctgccgtaaaatctgtattttagcttcgctcgcattcggcgagcatgtttatccgcgcgatgtatccgccgaggggatcgcaaaaatcacatcggaggacgttgcctatgcggcgagctgcggctgtgtgatcaaattgataggcgcggcccggcgcggggaggacggaaagaagatgacggcatatgtcgcgccggcattcatcaaccgcgaaacgcagcttggaacgatcgacgatgtgtttaacggaattctggtgcgcggggacgcgacaggggacgttgtattctatggcaagggagcgggcaaactgccgacggcttcggcggttgtcagcgatatgattgcttgcgcaaaggcggacggcagcagcgcgtctatgagctggaagccgtcacagggcggcaatgtggcgccgcagggcgatcatgttacggctatgtacctgcgctgccgtgcatttgaaacgaacgcgcttgaagaagcggtcaagatcttcggcaaggttaaggcgctttcacgtcccgataaaccgacaaacgaagcggcgtttatcacaccggcgcttacagagcgcgaaattgatgatgtctgcggcaagctggcggcggcgggagtcgacatccttggaaagattcgggtgctggcggatcaatgatcagactgcgtattccggcgacaagcgccaatatcggtccgggcttcgattcaatcgggcttgccgtcggactgtataatgaagtgactatggaggaatgggacggcgtgcagattgagtccctggacggcgcgcctgttccgacaggggaagaaaacttgatctattcaaccgcaaagcatctgtatgagctttgcggcgtcccgtttcgtgggcttcggatcggccaggtcaacaacattccatttgcgcgcggtctgggcagcagttcggcatgcgtcatcgcgggattaaaaggggcgaaccggctgatgggaaatcctgtttcagatgatgaactgatcaacctcgccgccgggatcgaaggtcatcccgataattccacccccgccttgactggcggcctagtgacggctgtgtttgaaaacgggcgcgtttggtatgtcaagcaggagattaaggacgatctgcgctttgttgcggttgttccggattttgagcttaaaacggcgtatgcgcgtgccgttctgccggcaacaatcgagcgacgcgacggcgttttcaatttgtcgcgcgccgcgctgatgtccgtttcgctttacagcggaaactataaaaatctgcgcgtcgccgctgacgaccgtattcatcagccataccgcatggggctgatctgcggctgtccgcaggtgatggaagcgtgttatgatttgggggcatatgctgtgttcatcagcggcgcggggccgacgatcatggcgattgtcgatgcatcctgccgcgactttggcgattgtatcgcacgccgactgcctgggatggggtttggcggctggagggtgcatacactgtctatagacaataccggcacaaaaatcacgcacggttgaacgaaacgcgtgtcccggtcatacgatatacatacggaggaatcaacatgaatttggtggtacagaaattcggcggtacgtccgtcaaggacgctgaacggatttttaatgtggcgcagatcattgcggacacgtaccgcgcgggaaacaatgtggttgcggtcgtttcagcgcagggggacacgacggatgatctgataacaaaggcgcaggagatcaatcccatggcttccaaacgtgaaatggatgtgctgctgtcaaccggtgagcagatatcgatgtcgctgctggcgatggctcttgaacgcatggggctgccggtcatatcgctgaccgggtggcaggcggggatgctgacggattcgacccatggcgcgtcgcgtatccgccgcatcaataaggaacggctcgataatgagcttgccaaacgcaatattgttattgtggcgggtttccagggaatcaatcgttatgatgatatcacaacgcttggacgcggaggctctgatacgagcgcggtcgcgctggccgccgctttgcatgctgacctgtgtcagatttatacagatgtggacggcgtttatacagcggatccgcgcctggtgaaaaatgcgcataaaatggatgaaatcacctatgacgagatgcttgagctggctacgctcggcgcgggtgtgctgcataaccggtctgtagaaatggctaaaaagtataatgtaaatctggaggttctttccagctatacgaagaatcccggcaccaagatcaaggaggtcgtcaaagtggaaaaaatgctgatcaggggtgtggcgcgtgataatgacgttgcccgtatttcaatcatcggggtgccggatcagccgggtattgcgtttaagattttttcgcagcttgcggcaaagaaggtcaatgtcgacatcattttgcaatcgattggacgcgacggtacaaaggacatcagctttacagtcagccgttcacataagcagcttgcgctggaactgatggaggagatcaatgaccgctgcggtggaaagggtatcatctgcgatgataacatatcaaaggtatcgattgtcggcgcgggtatgcagtccaatcccggcgtcgcatcgaagatgtttgaagcgctctccgaggcgaatatcaacatccagatgatttcgacaagcgaaatcaagatttctgttctggtcgcactcggcgacggtgagcgcgctgtcaatgctattcacgatgcatttgatctgtaatcctggacgctgaaatcacttgacggggttccgccagatcgatatcccgccgaaacaggaattttagttataaaatggccctgcctgatccgaacgataccaaccattcgttcaaatcaggcaggtttgtttatattttagagggatgtgagcgtttctgcggatgggaaagagttataaacgcctacattctccatgcacaggagagcggcccgatgggccttgatagcggcttctggaatagacttgtttttgacaagttcggcggccagaacgccggtaaaaaaggaggtagcgccggaataatccacaattttacactcggtggaggtgtccatgatgctgatcacgccgttttccgcaaccaggacgcctgcatcatccatttgaaccataacagcgcggcgaaccttgccggagagtatgctggcagaaattcgcgcagtcttggcattttcacccttgaggccgcagagggcggaggcttgagccagattcatagccagatagtccacatttttccaaaaatccagagagatattggaggaaagtaccgaaggtgtgaccagtaccggggtttgacattggtttgccagctcgatcaggtgagttgccacctccatgatagagggacccatgtgaatcatcaccaaatctgcttgggcaacggcatcccggcagcggtcaatgtcctggttggtcagctcgtagttggctcccaggaaatcaataaaagtgttatccgcgagatcctcaatgatgatggttgcaaggccgctgtagacgccctgggttttggatagaaagcggcagtccacatgttccagttccagagtggactggatctgctgaccgaaggcgtcgtctcccaccttgccgatcagggcggttgggacgccgcagcggacggcggcaatggcttgggagctgccgtggccgccggcgttgatggaaatctgccgtcccattttctttttgccgatcatttcgttgctcagttccataacgaagtccagattgagcacgccgagggatacaatcctggggaaattattctgcggcatcggtggacccccttgcaatcaatgtcaagccgatttcatccccgaggggaggaagtgtctcaccagttccggcgcggatcagatccagcaggcgcctgctgcccaccacacccacctgatacccagatggtccccaaacagatagctgaggagtggggagctgggccaaacgggaattttccaggcagagaaccgcgacatcttgggggacatggagttcctggccggccagagagagcaggacgcccgctccctgaaaacaattctgggtaattaccgcgtccggagtttctcccgattggcggcaatagcggttcaactcccgggctgcatcgtccagagaggcgtcggcccggcagtgcccgcagaggccgccggcctgctggactgtggactgaagacctgccagaaagtccggggagaatccggagatatcgtttgccaaatacagaaaacgacgcctgccctgtttgagcagataggaggctatctggctgcctaactcaccccaggggatgagaagctgctccgcattgggcacaccgaggggatcggtattagagagaaacaggatgggaaaattggcgcagaaggcctcccaactggagggcatgcgccgatgggcagtgtagatcagtacacctgccagccccatggatttggccttgagcagatactcctcctccagattgtgcattccctcggtggctacggtgagcatcagatagccataggaggcaagcacatcggaaatcccctgatttatttgggcgaaaaagggatcgctcagactgggaagcaggacaaacaccgcattcagcccgtcctttcgcaggctttttgccagcagattggaggaataacccagttcgtcaatagcatttaatactttgattcgggactgctcggccactttttcaggctcgtttaatacacgtgatacagtggcgatgctgacgccggcgtgctcggccacgtcttttaaggttgccgccataataatcttccttccttgattgtctgtgcgccggggaccataaaataccaagccagatcccaccctcccatgcagagggagagctaacggacaggaacccatccgtcttatgacagcatatcatgagctgattatcatgtcaattgttatcgttttcttttggtggatacaataagcagcaccgacccgtttttggaggccggcgctgcatatctaagaaaaaccgggagatatcagggcgtgtcaacgggcggcaaaagctgagagaagccggcgtaatgcccctgtttatgggggtgggcttcggcgcgatgcgcagactccagaacacagccttgcttgaagtccttcacctcatcggtcaagatatggggagatctgagcctgcagggcggccttctcatcctcgtccagatccatgaggggggcgcgcatatgaccgccggcaagaccgcggaactgcagcacggccttgaaaattcccatatcggcgccgcttttcatgatttcacagatttcattggcaattttctgctcctttagggcagtttccatatctccggccagataggcgcggtagacgttgacgaaatgttcaggcatggggccggaacagccggagacggtgccctcgcagccgatgaccagggcggggaggaacaggcggtccgcgccaaacagtacggaaaatttgccgtcgttcaggttcagatagtccttcagtcggatcatatccgaataactgtatttgatgcccaccacattgggacaggaagcgatgatctgcgccgccaattcgggggacaggtcattggcggcgcactggggaatggcgtagagatagatggggaagtcggacgacacactggcagacacctgttgatagtagcggagcattgccttgtccttcactccaaaaaaggcgggggtgacaacgccgatgccgtctgcgccgattttctccgcatggcaggccagacggacagtctccttcagagtcatggcgcccacatggatgtatacggtgacccttccagcggcggccttcaacacagtttcggccaccaattcccgctcaccaggtgtcatgttgagcatttcgcccgtggtaccgcaggggtagaggcaattcacccctttttcaatcagaaattccacctgctcctccaaggctttgacatccacccggtcctggctgtcgaaaggggtggtcatggcggtaataacacccttcatttttttcatggctgcttcactccttatggattgagccagtttttcggctcttttccgctcaggctgtcgatcacggcctgagcggtcatcatgcttatgttggaataggtttcccgagtttccgcccccgcatgggggatacactgaatgccgggggtgtgcaggatgggggcgcccatgggaaggggttcctgttcatagacatctacagcggccccggccagatgacctccggccacggcgtccaccagggcttgggtgtccaccagggcgccccgggcagtgttgataaagtaggagtccggcttcattttggcaaaagtctcccgattcatgacatgccgggtggcagggatgctgggcatgtggatgctgaggatgtcgctttgggtcagcacagtatccaggtcggtcagtgtaactcccaaggcggcagccttctcccgattgggataggggtcgtaagccagcagccggacttcaaatccggacagctttttggccacccggcccccgatatcgccgaagcccagcagccccacggtttttcccagcagatcacggcccaccgcgcggctccactgtccgtcggtaagtttgcgattcagctccgggattccgcgcagacaattgaggatcatggcaacggccagttcagccaccgcattggcattcatgcctgcggcgttaaccacttggatgccgtgccgcttggcagcttccaggtcgatgttgtccactcctacgccgaaccgcgccagaattttcagcttgggggcaatttggaatacctgctcgttccactggtccatgcctatgatggccccgtcaatttccggcgcccagacggccagctcctcaaaggaatagtagggcagctcatgatcattgagaatgacctggtgtccgctggactccagaagatgaatggccttttggcacagagtctggaagtgggatgcggtgattaaaatattgcccatgaaaaaccctcctgattggactccagccccagtcggcgacgcaggccggctcggagggagagatattccgcatccggcaggaggacgggggttggctcgtcaatcaggaaaacttttccccagtccttgccgtcgcggtatttgggaacgatatgaatatgaagatgggcgccggtgtccccgaagatcaaatagttgattttgtcgggatggagcaggtcggtgaccgcctgggccgcgcggtatacgctgtccatgagttcacggtactcctgaaaagacaggtctgtgaccttttttacgtgccgccgggaggccagaagcagccggcctgaatgcgtctgatcccggtggaggtacagtactcctccagggacagggccaacctccaccatatccggacgcagggaggcgtcttcgcagaacttgcagggatcagccattcttctcacctttccttgcggccaaatgcgccttgatcttcgggaagataaagggatagatcagagagagaacggcgataatgatgaagaagcaggagatcgggcgggtgaagaaggtggtccagtcgccgccggacagcaccagagcgcggcggaaatttttctcgaggatgccgcccagaatcatacctaaaatgataggcgggatggaaaactgcattttgatcaggaagaaacctaaaatgccgcaaatgatcataaggtagatatcctgaaccgtatggttaacggcgaatgtgccaacaaagcagaagacaaagatcagggggttcagaatgacctccggcaccgcggcaatcttggtaaaaatcttcagaccgccaaaaccgcagacagccataaagatgttggcgaagaatagaccgatgacgatcatatagaccttgtcgggagactccaccatcagcaggggaccaggtgtaatacccagcatcatcagagcgcccagcatgatagcggtgcaggcgtcgccagggatgctcagagacagcagggggatcagagcgccgccggagacagcgttgttggcagcttccggtccggcgatgccgtcgggggcgccgtcgccgaatttttcggggtgcttggaccagcgtttggcttcattatatcctacccaagaggcgatgtcgccgccggtgccgggaatcgcgccgatcagggtgccgatgatgctggagcggatgaatgtaggcaggcagtagatcagatccgccttggtgggcaggatacgctccagcttctgggcaacctttccgcggggattgccgaaactgtctgcaatattgatcagaccctgggagaaggcgaacaagccgatgagcaccgggatgttggagatcccgccggtaagatacacagtgtcaaatgtgaagcggtacgcgccggtggtggtgtctacgcccacagtagccagaagcagaccgattaaagcgcccatgatgcctttgagcacgttttcgctggagatgctggccacgatgctgacgccgaacagggccagtgcaaagctctcatgggcgctgaatttcagggcgaagctggagagaatgggggaggtccacagcagcattacggcggagaacagaccgccgaaggtggaagccgtggtggaaatggagatggcgcggcccggttggcgatacttgtgggccatggggtagccgtccaggcaggtagccgcagagttagcggtaccgggggtgttgatcataatggcggtgatagaaccgccgtaaatagcgccgcagaagatgcccagcatcatcagaacgcccatgttgccgtccagggacaaggcgaccggcagcatgatggacatgcccatgacggaggacagccccggcatcacacctacgaaaatgccgcacaggactccgcctaaaatggacagcagccccatgggggtgaagaccgacgcaaggccggcggaaaaagcggttaacattgatccaatccctcccttagaagaacctgccctgcggcagaacgacacccatgatcaccgtaaaaactacatagataaatccggtgattcccacggtggtcaggccgatccagatgggacggcgctcacccatagccaacatgacagccaccacgaacaacagcgtggcggggataaagccaaacaggctcatgatgacggcataggcgatcatgataacaaaaatcagaaaaacacaatggacgccggcagagcgatagtcgatcagcggctcctcagcggcggcggcctttttgctttccaacatggtctgcgtcagtaagatgacggaacataggatcaggccgcagcacaacatgatgggccagaaagcggccccggggtcgcctgcgttgccgctccgggtttcgaagttcgcggccatataaatcccggctgcgcccacggcaatcagtacgatggataagatatagttatattttctcacaggtaacagtccttcccttttctgacgaaggcgccggagagccggaatcgatatttcattccggccttccggcgcctggaagcgatgtgagttgggccttcagggggatcgcccaaaaaggcagagaaatggattacgcttggccggagagaagctgggtatatagttccatctgcccctccagaaaagcagtcatctcctcctgggccagattctcggtctgcatttccagggtatccagagtattggagaaggtttcgctgtcgacgccctggcgcaggttttcagacaggtagtcctggatggcggaatccacgccggcgggacaggagatgatgcagaagcccatcatctcatagtcgacctcgtccggaaagacttcggcgaaggtgggcacgtcggggaaggtttccagacgctcattggacagggcgccgatgatcttcacattgccggcctccacctgggcggtggcgttactgggctgggcgaaggtggcgtcgatgtggccgcctacgatggcggtgacgcagtcggcgctgccctcgtaggtcacattggatacgtcgatgcccaaggcattctccatagcggagatagccagggtgggggcggcgccggtaccggtttcacctacaacgatctcgccgggatgctctttcgcataggctacgaattcctccagggtggagtagttctcattgttgccaatgataagaacgaagggatccatcagggcgcaggccaagggagagaagtcgtccaaggtgagatcggtgttgccttggatgatgttgataataaagtcggtgttgaccacgccaagggtgtatccgtcagctgtagaattggccacctgggtcagcccgattagaccgccgttaccggtgacgtttgccacggagaagttaacggggaagtcgggcacgccgtcgagcacgccgcggacagacaggtcggtgccgccgccggcggagtattggacgacgacgttgacgttttgattgggatagttgcccaacccgctggaggagttggatccgccggagctgatggagttgccggattcaccggagctggtgagattgccggacccgctggagctgttgcagccagcggctgcggtcatcaacatggcggcggccagagccagggacagagcctttttcattcttttcatgttgcgatcctccttaaaaggacagtgtgtgttcttgttttgtctgtctatgtcaacttgcagaaacaagacctgagatagtccgccgacttcttcatgccgacggaagcgtcggggatgtcctgggggtgccatcttcgttcatactccagtgaaagccatccacagtatccccggtccttcatattctgaagaatttcaggccaggggaccacgccttcccctacaatccgggtgatcacgttgcgttcctcctctgtggggtgggagacatcggaggaggtgaaatcacggcagccctcccgaaagatcagatccttgacatgggtataatatagtttggaaaactgaagatgcagagcttggggccacgactcgttcccagtgaaggtcaggttggcctggtcatataggataccaacggctgggtggccgatctcccgggccagggagatactgtctgcggcggaaactgtcatggtgttgaagtgattctccatgaccagtttgattccgcgatccagagccaaatctcccagccggcgcatactgtcgatgagcagccggcgtttttggccatccggatcggcgtctccctgggcgaagtttccggcgtagatccggatgtacaacgaatcaagagcctgggcgtattggatgacccggcagacaccctgaatctccgcttcccggacaactgggtccaggtcattaaagcgggagtagtagggggtgagggcgataatccgcaggcccagccggtcggcctgccgccgaagggcggctagttcaccgggtttagcctgttgggagatggcgcactggtaaccatcctgcacaacgatttcagctccgtccagcccgatggcgtgaaagagatccagggcatggggaagggtgtactccggagtgcccatggtatgtccggcaatttggaacatggcggccacctcattccagtccgggcagtccggcggcggtgaggatgcggtgcatcagctcctgggttttataggcgtccgcgccgttggtaagcggctccttgtcgtgggccagacagtcgaaaaagtgatctacctcctgggtaaagcccatcttgtcaatcaccttggcccagccgtaggccaggggcgtcatggaggtggtatgggactgctctgcatcggtcattgtgatggagtcgggacagttgaccagtacgcttttgttatgtccatgcatctcaagcgtttctacccactgtccagaggcgcggttggctaccagcatggctatcgagccgttttcaaactgaagctgggcggtggtcagcgtctcgtagaggggatcggtgaacttggagcaggcctccaccttgatgcattcgccgcagaaataacggagaatatccaccatgtgaatggcattttccagggtagcccggtattcgctggcagggcggttcttctgagcgatcagtacgtcaggggagatctgcccatagatttccttcgccttgcggtagacaggggcataccggcgattaaaggcgatcatcagcttcctgcctgtccgggcggaggcatccgccatgtcgtaagcctccttcaaggtcatgcccatgggcttttcacaaaacacatcaacccctgcttccaacagtcggatcacctgctcggcgtggactgtcttgggtgagaggacaaaggcgcagtccagtcccagagacagcagttcgtccatattatgtaccgcgtgctgaatggcgtaactctgttgggtgcactgcacgctcccgatatgctcggcaaaggctcctgtcatttccacgtcgttccgggcggccaggatgggcagatgggcaatatgggcgatagaacccacaccgatcaggccgacccgatatttcttttccataatcaacagctcctttttggcagggacttaggacttggccaagaagccgccgtctaccgctatggtaaagccgtttacgtagtcggaggcgtcggaggccaggaagatggccgcgccggcgagatcttcgggaacaccccagcgatccatagggattcgggtgttggtttccgccatgcgggaggtctcagagcgcatgggggcggtcatatcggtcaccatatatcccggggcgatacagttgatgtggatgccgtagggagcggcccactcgttgcacatgtgcatggtaatattgcgcacggcagccttactggctgtgtatgggatcaccttaatgccgccctgataggaggtcatggagccaatgttgatgattttgccgccgcctccctgcttgatgaactgacgtgctacagcctgacacataaagaacagggcagtcagattgacatccagaacgtcctgccagtccttccggctgatgtcaatggccatgacacggcgggtaataccggcggcgttaaccaaaatatcgaccttgccgaattgctccaccgttttttggaccacaagttccggggtggtgttttctcccatgtccaatttcagctccaaataccggcgccccagctcctcaattttttcccttgtttgactgtgatcggaacggccgacgcccacaatgtctgcgcccgctcccgccagacctatggcgataccctgtcccagaccgcgggtggcgccggtgacgatagccgccttgcccttcaagctgaatttttcaatggtttccataaatcattcactcccatttgtttttcatatatggtattgaaaaatattacatagaatgtaaacgtattattttatgtgagaaaatatatcataatttagagaaaatgtcaatggaaacgccgaaaaatttctccggcctaatgcactattttctgagtgcagaattataaaaagtaacaaaagaattacaaaagagtggagcgggcagcttggctgcccgctcccggaaaaatcattcttaaacgcaaggtaacgataagtcctcatccagtgccgtatatatgcgagggactttcgtttgttatcgtgcggagcaaaaaaataaccgcggcatatgccgcggttatttttataatataataattttaaagctctgcggggaaaggctcgatctcaagcgtattttccgtatcgccctcgaccgcgctggtggcgagaatctgtgcgaccatcaagcggaatgtgttggacgaaacagttgcaccggcgacactgtccattgtatatggatcgccgcccgctttttcaaagttatcaatcaactgctttgaagctgcggcaggatcggtaccggacttttccttcatggaggacgccaactcgctgtcctgagacttcagcttggtttcatcagcttgagagaaagcatcgtactcctcgattgtaacctggtcgtttttgatattaagaacaatataatccttccagccgtattcatcaaattccttcatttgcgccttatatgtaccatctacatacataggggcgacaatgttcttttcgccgcccgagatcatgctggccaacaacggtttcatcagcttggaaaaggctttaaatgcggctgtcccgttcgttggagctgtcagattgttcaaatcctcgccggcctcggtgaagctttgagcgatcgcaggataataatcggcaggcgtgtcggactgcccctgtggattttgttcgggatcctcggtgatcagtacagaggaatcgtcctgctttgtcgcattgaattcaatatctgtgatctggctgtccttgactgtcaggcgaatatattccttccagcctgctgcgttaaattcaggcatgaccgcttcatagtcgccgtcagcatatttgccaagcttaatttcctgggtatcgccggttttagcggcttccaaagcctctcgcaccatgcgttggaaacggtaaaaatgttcgtctgttccctcgataagctccatcttttccacatcgtggccgacggcattgaactcgtccacgatttcatccatctggagcagcgccttcatctcatattcggtggcgccctcatggccgcttgcagcagcttcggacgacgcggcctcagacgacaccgcttcagggaccgagggcagagcggcgtcgctgctggtggagccttcattcgcgctgccggcaggagcagagttgtcctcacggcagccataatcagaaatttcgatctgtccgtccttaatgctcaacgtgataaaatccatcgtgcggtcgagcgcgggaacagtgtacgatacaggataatcgccgtcctgatagatctgctcaggctccggctgcgaggattccgccggttccggatcgttttttttacaggctgacaacgtgccagcggccaaaacagcagcaagcagcagcgacaccatttttttcatgtagaattaacctccgatcgtattgtgggcgctccaatgcgtccagttgggggttgtgcaaagattacaaaaaattataccattcgacagtctgaaagtcaatccgcatacggatatgaggcagctttggcatatgataaaacgcctctgacgctgaaaggccgctcgccgcatccgcggcgggcgacgatatggggtgcgttcggcttctcaataaattaaaatcagacggtggggctttcaccggaggatgcatccgagccaaatgtatcaggtataggaaggggcaattcatctgcaccgggagccgtatagggagcgacctcaaacgcggcgctctgcggcggcaggctgcgtgtagaagcggcgctgtgcaggacatttaactgatcgcctggtttaagggcgtcgaaatcgagataaaattgcgtactgctgtcataattgaatacatactgcataccatttggatcgattggatcgagaagaagctggccagccccctccttatcaggatccggtgatacttcaacaagcgttccattataattgacaagatcttcaagtccaagatcgttgatcgctatggcctccgtttcaatgggagttgttgaatcgctttgcgttgtaccggcgctgtagtagacttctaaaaacgctccgttgccgatggatgattcttcaaaactgtatgcagtgttttcagtaagcgcaaagttcatgcgtggtgaaaaacgactgcccacggcacggcgcatcattaaaacggtttggcccttgtcgttgacagcaaagtcctcaaccacgccccggtaaattgcagcgtccgccacggcaattttgctttccggcatggaagcggcgcctgcgagcgggttttctgccgaaagaggctgtgcaatttcagaagcggccgccgaagaagcggcggaagtaatggtggatgagaccggcgcagaggaggtgtcaggcgcctgcacggcagaatttccacaggcagtaaaggtagctgcggcggcgagcgcaattaaaatgttggcagtatacttcataatcatattccctcaattcatttaatttttccaaatatgtttttggaaatttgtatcggcgattatttagtgcataggaagattatttttactgcatttattttagagaattgtaaaacgctccataaattccccttgaggttgaatcttgacggattgcgttgtataataaccgaaaagcggttattatacaagttgtagccaaggcgatttgcaggcgatatctgctgccgcccgatggccaatgataatcatgccgctttttggatggacatggtatcaaattaaaattaaaagcatctcatggctattgggttcggcggagcgcgatctcccccaagcggccgatgatgtcatttattgcattcagcggaaagagcggtgacggccaatgccgaacttaaattatatattcaaacggatcgccggaatggattacggtgcactgttggaaacggcgcgcaaggtgcacgcgcgctccgggaaaggaacgctggtgtcgctggcggatattgtcgcatgtggatttcgttatcaggcggggtatatggattacctggtttttgaatttgaccgtctgacagccgcgcagcgggcgacctatattacgcgcggaaaaaacaatgcttatgtgcggctgcttaatccgcgcgaaaactggcatatccttgaggataaggtggaattcctcaagcggtttgaggggattcacgggagggaatggatcgatctgcgtgagacggatgaagccggattcgaatctttttgtgaaaagcatccacagatcgtcgtaaagccgcttgacggcacatgtggccgcggcattgaatttattgaaacacagacgcgaattgtcgggctgtttgatatgctgcgcgagggcaggcagtatttggcggaggaatttattgtccagcatccggacatcagccgtgtttatccgctgtctgtcaatacgctgcgtcttgtgacaatcaaaaaccatgatacggttcatctcgttttttccagtatgcggattggaaacggtaaacgcgtcgacaatctcaacagcggcggcatggctgtgattgtcgatatgcagacaggtaagatcagcacgccgggcgcggataaggatggaaaggcttatgaccgccacccgatgacggatgtcccgcttgtcggcgtgcagatcccgttttaccaggaatctgtggcgctggtcaagcgcgcggctctcaccgtgcctgagcttggatacatcggatgggacgttgcggtgacggaaaaagggccggttatcatcgaggccaatcattttccggggcatgatatttatcagtttcaggtccacttgggtccggaccggatcgggctcgcgcctcgctttgataaagcgattgaaggactgtaatatgaagggagcggcagcctgcgctgccgctcccttcatatccggtattttgctcagacgccgcaggcaagccccgtaagcgtatcgccggcaatgcggtaaacggtccaatcgtccatgggccgtgctccgagcgaacggtaaaaatcgatgcttggacgattccaattaagacacgaccattccagacggccgcagccgcggtcaatggcgatacgggccaactgttggaggagggccttgccatacccatggccgcgatattcaggcaggacaaacaaatcctccaaatagatgccggcgcgtccgagaaacgttgagaaattgtggaagaacaggacgaagcccacctcatgtccgccgtcaaccgcaaagaaaacctccgctttttttcgttcaaaaagccattcccgaagcaaatcttctgttgcaacaacctcgtcaagcatacgctcatactcggcgagctgccgtataaaagacaggatcagcgggatatcctgttcctgtgcggttcgaaaggatacagttttctgcatttctcattcctcctctggtccccagggcctttgcaggccttcatagccgcgggcttctatcagcgcgtcagccgccgcgatggcgacggccgcctccaccaccgggaccgcgcgcacagcgacgcagggatcgtgccgtccccggatgttaagattgccctgcgtatgctcgataaagtcgacagactgctgcgtttgagcgattgaagcggtcggtttgaaggcggcgcgcacgatgatcggcatacccgaggagatacctccaaggataccgccggcatggtttgtttgcgtcacaatagcgccgctgcggatcgcaaacgcgtcattgtgctgtgaaccgcgcaggtcagccgccgcaaagccgtcgccgaattcaacgcccctgactgcggggataccgaacagcagggacgccatacggttttcaagcccgccgaacatgggggaaccgataccggccggaaagcctatgacgccgcattctacgacgccgccgacggaatcgagcgccatacgcgcttcttcgatcgcatcctgcatcattatgccggcggcttcatcgtttgttggaaaatcgcgcaggccggcctggcgcagcatttcttcaccgagatgaacgggatcatagggcgtatcggagattccggccgcacgcgccagatgtgcgccgataaaaataccttcgcgctccagcaattgctttgcgatgccgcctgcaaatacaatcggcgctgtcaggcgcccggaaaaatggccgccgccgcggatatcgttataaccttcataacgcagaaaacctgtgtaatcggcatgaccgggacgcgcgacgctggaaaattcagcgtagtcggacgaatgggtatcgctgttacggatggcggcagccaagggcgtgccggtcgtcacgcctttgtaataaccggagagaaattccggctcatcgctttcacggcgcggggtggacgccttgctgcgcccgggcgcgcgccgcagcataaatgatgagagcgcgccgcggtcgatcgccaacccggcgggcagtccgtcgatcaccacgccgatgcgcgggccatggctttcgccaaagatcgatatttttaaatagttgccccaactagatgacatcgcaaagccctcccagttttttaaaatcctcaaagaaatcggggtatgatttgtcaacagcttcggctccccggataagaaccggttcccggcagaacattcccgctatcgccgcgctcataacaatccggtggtcgtttgccccgtccgctgtgccgccgcgcagaccgccgccgtggatcgtcagccggtccggatattcgtcgacagagccgccgagatcccgcagcagcgccgcaaccgtcgagagacggtcgctttccttgatgcgcagccgcccggcattgtaaatctctgtatcgctctgcgcaaacgcggctgtgacagccaggatcggtacaaggtcgggaatcgggccggcgtcgatgcggataccgtgcagcggcgcgtgcgcacaacggattacgttcgcgtcacggcttatccgcgcgccgaactgcccgatcagatcaaaaacagcgcggtcgccctgcgcagagccgtcgcgcaggccggccagacgcacatcgccgccggctgcgccggcacagagccagaatgcggcgtttgaccagtcggcttcgaccgtccgttcgccgctgcggtacgcctgcccgccggggatctgccagccggattcggaccgtacgacccggataccggactgtgcgagcgcctcaagcgtcatatcgacatagccggccgattgcagcggggatgtcagaacgatttcgctgtcgccctccacaagcggaagggcgaacagcagcccgctgataaactgggaactgacgtcgccgggcagcgtgtagcggccggctgcaagacggccgctgatggaaaacggcagccggccgtcggaaaaggcgacgccgtgcgcactcatctgctccatgagcgcgccgagcggccgttcaggcaggcggccgccgccggtgaatgcggccggcaggccgagtgccgccgcgacagggagcagaaagcgcagcgtcgaaccgctttcgagacagtcgaacggttcacgggcctgccaggacgcgccttcaaagacaactgtatccgcctcctgcgtccagtttacgcccattgcccggagcacacggagcgttgcccgcatatcggacgaggcggcgaccggaaatacccggcagggcatcgctgagagcgccgcgcagatcagcgcgcggtgcgccgccgacttggacggcggcgctgcaagcttgccgcgcggcgcgtgaggaaggatgcgtacatcgctcatttgctgcttccctccataaaggcaagaaggcggcctgtcgccgccgggtacagcgctgcctgtccgatagagcgcagtatgatgagcgtgatgtcgctgccggcgcgctttttgtcgcccatcgcatgcttacagagcgtctcaagcgggatatccgtttcggccggtaggccgtgcgcgcggcagcaggattcaatccgcgcggccgtttggacgggagcaagcccggcgcgctcgcaggcgcgcgccatcatcgccataccgatggccacgccgtgcccgtgtgtgattgtaaaatctgattgcttttcgatggcgtgtccgaacgtatgcccaaaattgagcagctgccggcggcctttgtcgcgttcgtcatcctcaacgacctggcgcttgagatcgacgcagcgcgcaatgatcccttcaagcgcgccgggaccggccagcgcctgctcgccgcgctcaagctgctcgaacagctcccggtcaaaaatcgcgccgtatttgatgacctcggccatgccgtcggcaaaagtttccgccggcagcagggagagcatgtccgtatcgcagacgacaagcgacggctgccagaacgcaccgacaaggttttttccctgtgggatatcaaccccggttttgcctccaacagacgaatccaccattgcgagcagggttgttgggatttggataaattcgacgccgcgcagccagcttgcagccgcaaaaccggccagatcgcccaccacgccgccgccgaatgcgacgactatatcggtgcgtgtaatttcatgctcggaaaaaaacgcataagcctgccgaaccgtatcgagcgttttggaggcctcgccgttcggaaagacgaacttgcagacagaatagcccgccttttcaaacgccgtcaggagcgtctgcgccggctggcggccgtcgggaaaggcgagtgaatcgacacggtcgtcggtgatgacggccagctttggcctgcgcgcgccgcagacaggggacagcagctttggtatgcagtcaagcaggccgcagccgatatgaatttgataaggatgcccggtgttgacggaaattgttttcatcgatcaagcgcctccttaatagcccgcccctcgtcaagcaggcggtagagcgtctcgccgtcatgcgcggcgatagcggttttgaattcctgcaaatggctgatgatcgtgtcgatttcgcagcataagtcatctgcgttgtccaaaaataattctgtccacatatgcgggttaagcttggcgacgcgtgtcaaatccttgtagctgcccgctgaaaagccgctgtgcatctgcgcccgcgggcttttaatgtaggcgcttgagacaacatgcgccaactgagacgtaaacgcgatcatactgtcatgcgcctcaggcgttgtgatggtgacgcgcgcaaaaccgacagcatgaaacaggcgttccagacgcgtctgtgcatcggcgggcgtatgtacatctggcgtcaggatcatgctggcgccgtgaaaaagatccgcgtctgagccggaaaatccccaggtttccctgccagccatcggatggccgccgatgaatacaaacccatgcgcggcgcaaaagccggaaagcgcatgcacggtacagcgtttgacgccgcatagatcgacaatgatacagcccggtttgaaatatgtaatgttttttttgacaaaatcaattgcctgctgcggatagagcgcgacaaatacaacatcggaatctgaaaaaacagaagcatcctctgcgcagcggtcggccgcgccctgtgccagcgccgcttctgtcgcggcggggtcggtatcacagccgcagacggtgcattctgtgtacgctttcagcgcccgcgccattgacccgccgatcagcccaagtcctgctatgccaacgctggcgatgccgttgagatgtattttttccatatggattcctccagggcagaccgccggtaaaagcaggaggccgtgccggttagtgatgccattgaagcgggaacggattatcccggccgcaaatgacaaaaacagatacctgatattataacatctcacctcggtaaaatctacttgaggcgaaccaaaatgatggatttcagtccaattccgtcaaagttgtgtagaaaacaggatggggttgcatatttttataaaataaggtaaaataagaaaaacactattcttgtatacattggaggggcaatatggaacaatttgatgtgattatcatcggcgcgggtccggcaggattgacagcggctatatatgtacagcgagcgggattgcgcgcgctggttttggaggaatatgtctgcggcggccagatcgccaatacgcctgaggttgaaaactatccggctgttaccaagatcagcggcgtcgacctgagcatgaatctgtataatcaggcggttgagcagggcgcgcaggttctgtttgagggtgttggttccgcatctctggagggccgcgaaaaaactgttacgacaaaaagcggccatacctattcggcgaaagccattattattgcaaatggagccaagcggcgcaagcttggcgtaccaggcgaggaggagcttgccggtaaaggcgtgtcctactgcgcgacatgcgacggcggcttttataagggcaaaacgacggtggtggtcggcggcggcaatacggctgtcgaggacgcgctttatttggctaatctctgcgagcgagttcatatcgtgcatcggcgcgatgcattccgcgccggtcgggtgctgaccgacgcgctgcaaaaacgggaaaatatcaccgttcattttgacgctgtgccggttgaggttgaatccgatgccgccacaggaatggtcagcgggctgcgcatacgaagtgtcaaaacgaacgaggaggagacgatcggcgcgcagggcgtttttgttgcagttggccttgttcctgacaacggtttgttcagcggacaaattacacttgaccctgcgggctatatcgcggcaggtgaggatacccacacaaatattccgggagtttacgccgccggcgatacgcgcgcaaagtcgctgcggcagattgtgacagccgcgggcgacggcgctgtcgccgcttcggaagcgggaaactatatcatgcagctttaagaacctgtatttacagccgccgaacgctgtcagggcggggccttcgcccagttttgcgttaaactttattgccgggcgacagcccgcctgcgaaaatttacattgaacgggtgcagaatctcccgtatatccggcatttttcggctatggacacagggtataagagccgctgtgtttcggtgcgattttccggatgacatttaggtatgatcgtgttaaaataatcagtgggctgctgcgctcggcagatcactggagggattttaatggaacggatgattccgcttgaaaaaatgagcaaaaaggcaaagcgggcttattatgccgcacggcgcgggacttggggtgaaatcagccctgtgacacgcgcgccggcaaagcccggcgcttataaacgtaaaaaatccggcgcatggaggaaggacctggatgcgccggattttttatagattgctctgcaatctataaaaattggccatccgcgcctgggacggcgtggggccgtttgattaaactgcatcgatcgcagagcaccgtttttgatcttttattagattttgtaagaagttgatttttctagaaaattatgctatcgtctgaagtataaaagcggtttccaaccgcctgattatgtaaggacgggagtatctcccttccttacagggtatgccgcccgcgccggggcgcgtttttgaaaggctgcggaaccctgccgttctatagtattgcagcgtccgcacagtatattcatcctgtttttaattctttttggggagatggggctggtgtatcgtattttggccatattggcggcgctttccattgcgctttgtttttgccttccggtcgccgcggcttcctatcaggatgattgtacggatgttctgaacgatcatattcgtgaatacaatggattttcaagaaatatttctgatttcattgtgttttccggttggtcaggatgcggcgatcgatcagtcattacggtggacagccgcgaggcttcagctacctaccggattgacggcgcgaggcgtgtacaaattcagcttttttcgtcacagtcaacgatcgccgtaccctctaatgattactatcgcatgagcgtgcgttcggacgaggagcttggacaagcacgccgttgttattatgaccggtcgaaggacgtcgtttttatacaggaaaatggcagaaattattcgctctgcaacgaacgccgcggcctgatgctgcgtgaggatgacagcgcgctgcgaaaggactgctattatgggctgaatgtattcgtatcgacggacggcgtgtcctatcagccggtcagcgatgtcaggcttgataaaatagaatcgcaaaatttggaggagggaacgggcgtttttgtccgtgaaacatattccgccgggctgccgtcatcggctgcttatgtgcgtttggtgtttatagaatgcgcaaaaattccaggcagaggcgccgctgatattacagaccggtcgaatctgcactttctgtccaaggttacatttgagggcggcgcattggagccgggcggctcgtccgaaccggaaagcggctcgtccgaaccggaaagcggctcgtccgaaccggaaagcggctcgtccgaaccggaaagcagttcgtctgaaccggaaagcagtcaatccagctctttggccagttcgtccggatcgcctgagagttcgtcatcggcgccggtcaattcatctgaaccggagaacggtatatctgagccggaagatatactgccgggagcaacgggcggatcgacgggaaaagctccctcggggagacgtatttccaataaaccgccgctgacagcaagcccgccgaaaactgcggatgtatggtattcggaatctgcgtccttagagcagccgaatgagcaggcgtcgttggctggcggatatgaagctgcccagacggatcgcataccgttttctgatttctcctccggcgatgacatgggaataaccgtgcatcacaatttcagcgaagggtcttccgggcgggcgcccatacccgagcggacactgtaccacggaagtgtgggcggagccggcgcggcgttggtaattgcgggcgcgctcaagaatctaagacgctgaaagggctttacatgggcgtttaggcatggcagattgttgacaaatcaaccatgctgtttataatagaactatattttgtcgatttgcgtcgttggttttttgaagtttatgggaattttgtctgacgacgaaagaaatcgcatgttttcgcgcactgaatctatgggcgcaggatcataacgagggggatgtcagttgaacggattattgtccatcacagttggcgcgctgctggagcaggttgctgatctttacccaaacgaccaggcgattaagtataccgatcgcccatacgacaggacctggcgggaattcgatgacgaggtaaaccggatcgccaagggccttttggcaattggcatcggaaagggcgatcatgttgccatttgggccacgaatgtgccggaatggctgctgacgctgtttgccacagcgaagatcggcgcggtgctcgttacggtcaacacgaattataaagtgtttgaattggaatacctgctgcgccagtctgattcgaaggcgcttgtattgatcgacgggcttaaagacgtcaactatgtcgatattgtcaatgagctttgccccacactgaaagattgtgcgcctggagcctataagaatccgatgctgccgttccttggggacattatctatgcaggcaaaaaagagacgccggccggtatgtatggttggagcgatttggaaaagctcggcgagcgtattaccgacgaacagtttcgcgccgttttcgacagcgtggacccacaggacgttacaaatatgcagtatacatccggtaccaccggattccccaagggtgttatgctgacgcattataacattgtcaacaacggaaagtgtatcggagattgcatgaagttcacacatgaggaccgtttgtgcatcccggttccgttttttcattgctttggccttgtgctggccgtgatggcatgtctgacgcatgcttcgtcaatggtgccgatcgaaacataccgtccgaccgaggttatgaaggcgctccagaatgaggaatgcacggcggtgcacggcgtgccgacgatgtttatcgctatgctggagcacccaacctttcacgattataaattcccgcggctgcgtacaggcattatggcgggttcgccgtgcccgattaaggtgatgcagcttgtcgtggataagatggggatgcgggaaatcacgattacatatgggcagacggaagcttcgcccgcctgtacaatgacgacgacggacgacagtctcgatctgcgcgttgcgacggttgggcgtgccatgccgtatgtcgaaacaaagatcgtcgaccctgaaacgggcgagactttgccgccttatacccctggtgagttctgcgcgcgcggctataacgtcatgcgcggttactataagatggaggaggccacgcgtcaggcgatcgacgaggacggatggcttcattcgggcgatttggcgatggttgacgataaggggtattacaagatcaccggccgtattaaggacatgatcatccgcggcggagaaaatatttatccaaaagagattgaggaattcctctatacacatccgcttgtccgcgacgtacaggttgtcggcgtgccgagcgagcagtacggagaggaaataatggcctgcatcatcccgcgtgcgtgggaggacgggcttgacgaaaatgagattaaagacgctgtgcgcgccaatatggcgcgtcacaaggtgccgaaatacgtgctgtttatggaacagttcccgatgaccgccagcggcaaaatccaaaaatataagctgcgcgagatggggatcgagaagttcggccttcaggatgacgcggcgattgaaaccgcgtaatgcccggcggggcgaggccccgcgcttcccgattggagtgatggaatcagatgaccgttaatgaacagaacctttgcatgggctgcatgacgccgaaatttgaaggcgggaaatgcagcatatgcggctttgacccggatgtgccggtcaatatagattttttgccgccccgaacagtgatcgcggagcgttaccttgtcggcgcgctggtagccagcgaccctgaaggcgcttggtatgtcggctatgatcgcagggaggatgtgcgtgtatgggtccgcgagtatgcgccggccaatatcatccgccgggatcgtgtgacgcttgcagtacagccccttgcaagcgccgaggcgcagtataaggcgctgatggccgattttgaggatctgagttcgatgttgcgcacgcttggacagcatgaaaaggttttgcctgttcttgatattgtcagggattataatacggtctatgctgtttatcgctacatcaagacaatttcattggagtcttttttggaaagaagcggcggcaaactctcatggcgtcataccaaaaagctgctcatgccgttgtttcacaccgttgagaatgtccataaagccgggcttatccaccgtggactttctccgcgcacgattcaccttgatcagaccggcgcgctgtggcttagctgctttacaattgcagcggcccggacaaataaaagcgaattgaaggcgcagctctttgacggttattccgcgccggagcagtattcgctcaacagctggcagggcacttggaccgatgtttatgcgcttggcgcgcttacatatcgcgctgtgaccggcggagatcccccagccgcgctcgaccgcatttacggagacgatttgcttgatgcgggcatggttggcggggacttgacggaaacggtcatcgcggcggtcaatcatgcgcttgcggtagaggtcgacgaacgcacgcctactgttgaggcgatgattgcaagctttttgtcaaatgaagcgtcgaatacagcgatttatactgccgcgcccagaaaacagccctatgaacctgctttgcagacggctgccgtcgcgcagaaatccatgcaggcggcgcagcatacgcagcgtgagattccgctgtatacgcctgctgtgcggccgtccggcgatgatggaggcgatctgcttctgccgccggatgatgactgggagcgttcggcccgcgccgggaaaaagagcgggaaaggcggcaaaagaaaagtgaaaaaatcacatccgatgctgatgctgtttttatcggccctgatcgccacggctctgctgggcggtatactgtactggtttgcgacaacctatcttggagatttgttgtcgcctgcctccagcgtcgccgcgagtgaaacttcttccgcggcggctcaggagggcgttgacttttcacagggcgatacagccgatgatacggtgccgcgcttcgtcggggcgaatgttgattcgatcaaatcaaatgagcagcttaacagcagatatgaatttacatatcaggagaaatatgacgatgtttatgaagctggcgtggtttgtgatcagcagccggtggaaggcacgaagatgcctaatcgtggaatgattacgctgtatgtctccaaggggccggaaaagacggaaataccggaggatgcagttggaatgcgcgttgaagatttgctcaagcagtttagtgaaatggagatcaaataccaggtaattgaaaaagcatacagtgaggattacgagccgaacacggttgtcagcaccgatccggcgcctgggtctgagattgacaaggaaaacgatacggtgttcgtctacattaaaaaaattacggagtcgcgcagcagccgggacgaacgtgacgataaggagctgtcgtcatcacgcgcttcatcatcttcccgcaagccaagtgacgatacggtttcccgcaagctcagaccaaagagcgagaatggattttataatgaagatggggtatgggtcgagatcatcgactgatcatatgccagtgaataagcgccgaagcggcggaacggagttttgatatgaaaactgcattttcaaccttgggctgtcccggctggtcgtgggacgaaatttttgcaaccgcaaaggatttgggacttgacggcatcgaggtgcgcggcgttgaaaatgaaatgtttgcgccggcgattcgcgtatttggccgtgatcgcatcgatgccacgcggacacggctggaaaaggccggcatgagcatcccgatgctgacatcgggcgcatgcctcggtttcacaggggattatgagcattatgtggatgaggcgaaagcatatatagaccttgccaagacgctgtcatgtccgtatgtgcgcgttattgttacgcctgacgccgcccctgcggaacaggaggatattgaccaggtaaaaacgctttatatgcagctttgcgcctatgcaaagggttcgggcgtttctgtattaattgagacgagcggaaagctcgcggattccgcagctatgcgcgcatttatgcaggatgttgatcctgcggccggcggcgtcctgtgggatttgcatcatccatatcgattttttggcgaaacgcctgcgcagacctataataatattgggccatgggtgcgttacatgcatgtcaaggactctgtaatgcagaacggaaagttacagtaccgcatgatggggtatggggatgtgccggtttttgatgcgctcaagttgcttgacgaaaatggatataccggttttgtctctcttgagtggctcaaacgctggtgtcccgaccttcaggagccgggcattgtgtttgcacattttgccagctatatgaactatttaaaaaaccagttgaaataaatacaaagaaaaagagccgcgcatccttacaggatgcgcggctcttttttcattgatgcgcataacgcttgagcatccggatgtcctcaccgcagaactgaagcggccgataggtgcacagcaggcgtgaaaggatacggtcgccgtaacgttcgcgcagaacagtttcatcaaagtttgtgctgatgatcgtggggcggcgttctatgatacgcgcattgattagattatacagcgcagcgacggtgaaagcggtcgaaaactccgcgcccagatcatcgattacaagcaaattacattcgagcgcaagcgcctgataatcggccgcatcagagggagcacgtgaaaattgctgcgcctgaagcttatcaagcaggctctgcgacgttgtataaaccacgccaaaccccttttcaatcacttcatatgcgatggcgagcgagagatgcgtttttccaagtcccgttccgccataaaacaacaggctttcgctttgtggggtaaaaccgtctgcataggtcttacaaaaggaaaatattttttccattgcccgccgcgcaacaatcttgtatgggccgcatggagcatcgggataataatcaagacggaacgtttcaaagcggcagtcgtcgataccgcaagcatcgctcaaagattgatatgctattttgcggagcaggcgggtcaggcaggcgcattgcttttgtccaatataacctgtatcgtggcacacagggcatgcataatgaatcttaagaaagtcgtcgggcaatccggcctgcgccaaaagccctgcccgttttgtctgtaaggcttcattttcagcacgcagccgctcaatcagcatgggcgcctgctcaccaccgctgatcgctgcctttgctgcgtcaagccccgtcgaggcaagcgcgcggtcaatgctgcgcatttgcggtatggcgtcgtaaagcgccgcacgccgcgcatcagcttcattttgcgcgcgtgcacgcgatgcatcaagcgtttgcagcgccttgcgccagatttcttttgaatatcccacagtacagcccacctcctttatagatcagccgtccaactgacgatgcagcatcgcacggattttatccatatcaatcgaagaatcccttccggtctgcgccgaacggttttgaggtatggacctcttgacggcggcgctgtcatcgatggcctcccggacagtggaaatcccttttgatttccaggcggcaagaatcttgtcggcataagcaaaagaaactttgccggtattttcaagcgttttttcacaggccagagcgatcagcttttcatcaattcccaacgcaaaccattgttcgatgtatgtacgttccttggatgtcaggccgcggttatagataccaaacgcctggatgacctttttttcctgatcattattgcgggtgaggcgaagaatttcctgttcaatctgatcataggtggaaatacccttttcaagccatgcggcggctgttttttcgacatagtgcatgcttttatgtcctgttgaaacgcagtattgcagcagcatcagtaccgcgtcggtcgccaatccataatagctgtgcagcgcggccagaatttcgctctcgacaggcgtgagcggcgcgcccaatatttcctgggagagagttaaaagctgtgcgatggaatcgtcattttttgccatttcggatacgtcgtcacgcgaaatcttgggacgcgcggcaatcgttacgattcgctgtccgttttcaccggcctgtgtctgtacggatggaacaggcccaggcccgccaggagccggcgaggaaatatttgtctgcgtcggcggatcggcatcctgctccatggcaggcgaatcgcttaattgtacaattccggcgccgacccaatagttaagcgcgtctgcaatatccggcgcggaaatacaaagacggctggataaccactggatatcggcaggatgctcaggatggcgaagcatcaaaagcaaaatttttaaagataacggcgagcacattttgatatgctcgtccacaacagcggccggcacggcaaaaaccgacgaccagatgccggaaccaatcgtataagacatagtacctcccaatcaaatgatttcagccacaggggacgacggcggcaaacggcttggccgtttgccctgcgcatattatagcacagcgccctgtttttttaaagtgccggcgcgggggaggacagaaaagagcagccgctggacagagatttcctgaattttaagttgcactgtctctatggtgcggtgtataataaatgtaaatcgttataattttaggaggggagcgggaatatgatcggcgatctgcactgtcatacgcgtgtttccgacggttccacaggaatcgatgatgtggtgctgtatgcaaaacgcggcgggcttgatttcgtagcgattacagatcatgatacgatggccggcgtcagccgggctgaacagctcggacgtcggtgcggaatcggcgtaatcgcgggagcggaattgtcagcctgggattttgtccgcaaacgcaaggtccatctgctgtgctatctgccgaaaaatccggatcgcttggaaggactcatgaagcatacgcgtgaaaaccgtgataaggcgatgcgtgagagtatgcatagggttatgcgcttgtttccggtgacagaggagcatattctgcgttatgcacaaggctcctcgacactgcatcatgtccatattatgagtgctctgatggatcttggatatgcgaatacggtttatggcgatctgtttcaggagctgctcagcccgcatggaagctgctacacgccgttttcttatccggaggtacgcgaggcggccgctttaatcaaaagcgcaggcggcatctgtgtgctggcgcatccgtccgtctatgattcaattgaattgatggcggagctggcgcaggagggcgtgatcgacggtgtggaacggtaccatccacgtgtaaaggccacggatattccggtgatcgagcaggttgcctcccgctatgatttgattgtgacaggcggaaccgattttcatggcgcgttttcgccaaagccaaatccgcttgggacatgcataactgaacaggcggcgttaaaacgtatttttcagctttccaaaaacagacaggattgaggcggccgtcttattgttaaaataatagacaggctcgacgggaggattcatggatataaaagaacaggcattgaataaacattacgagtggaacggtaaaattgaggtcatttcgcgtgtgccgattgaatcgcgcgaggcgctttcgcttgcgtatactccaggcgtggcgcagccttgcctggaaatcgaacaggatgaggacttgtcttacgttcttacaaggcgcggaagcctcgtagcggttattacagacggtacggccgtgcttgggctgggggatatcgggccgtcggcggccatgcctgtcatggagggaaaatgcgcgctgtttaaggaatttgcaggcgttgacgcgtttcccatttgtattgacagcaaggatacggatgtgattgtcaacacagtaaagctgattgcaaaaagctttggcggaatcaatctggaggatatctctgcaccgcgctgtttcgaaattgagcggcgtttgaaagaggaatgcgatatccctgtatttcatgacgaccagcacggaacggcaattgtggcgtgcgccgcgctgatcaacgccgcccgcgtgacaaaccgcacgccccaaaatctgcggattgttgtcaacggcgccggagcagcgggtatttccgtggcaaagctgctgctgcggatggcgtttggagaggtcatattgtgcgatatcggtgggattatctatgagggcgccgattggctgacgccgccgcaggcacaaatggcaaaggtgacaaatccacgcggtctgcgcgggacgctcgcggatgcgatgcgcggcgcggatgtattcatcggcgtttcaaagcccgggctggtcacacgtgagatggtggcttcaatggcaaacgatccgattgtatttgcaatggcaaatcccacgcctgaaattatgccggatgaggcaaaggccggcggagcggctgttgttggtacaggccggtcagattttccgaaccagatcaacaatgtgcttgtatttccgggaatctttaaaggggcgttagcggtgcgcgcacgtggcatcaccgaggaaatgaaggtggctgccgcgctggcaatcgcttccatggtgccaaacgagcgcctttcggccgattttatccttccggatacgcttgacaaacgcgtagcggattgtgtcgcacagaaggtcgcggatgaagccgtgcgcgccggaattgcgcggtatattccccaaataggaaaataatgggctgcgggtgatgcgcccgtatcaatttacaccagaaaggcggaattttacagtgaactgcgacgacagcgacatcaaaattgtgccggataaaccgtcaaaagtattcgatatgtcggaaggagcggcttatgcgttcatccgtgaaaagacaaacggcaacatggagaaggcgcgcgctttgggaaagcggttcgccggagaactgaccgccggacgcactggtatggcgcaatttggcgttggcgcgtttgatgatcaggatacgcttgcacagcgtaatgtcttgtttgcctttattgtcgggcgcgttattgaggagatggctcctaattcaattgtcgctcaatccgcaatgtcagcattttacgagacgattgagcgtacgtcacctgagatttatcagcagatcagcgattccgctgcgttatcgctttatatcctttcggcgcgctccacccccggggatgaaactgcggccggcgaggtgtttgcaagactgtgcggccgtgagggcgacgctctgtttgttgcttacgggcgggagctggccggttattttatggatcactgcacaaaggaagcgatttgtgttaaaatgatccgataataagtaaaaatgccagggcggcagttacatctgtcgtcccggcattttttatagattgcgttttacaatctatagaaaattggccatacgcgccgtccctggcgcgggtccgcttgattgaaattcgcctgcccgcagagcggacagatacgcaaaaaaatagttgcttctcaactattttttacgtgttattcttttgaagatcggtgcaaatgctccataattttttgcttgtaaaacaagccaaccagaccgattgccaacgtgagcaaaaagacgagcgccgcagtgatccagttgccgcggctcattgtagcgcccatcaaagttgaagtgataatagatggaatgcgcgcaaaggtagaaagcaataaaaatcgtgacggcttaattttactaatgccggccaaataggtcagcatgtccttcggtgtgcctggaatcagaaacaggatgaaagtgacggtttccacttttttggtattatttaaaaatttaaattcatcaacttttttctgtccgaatatacgtaccacaagacgctttccgaagcggcgcgtcgtaaaaaagatggctgatgaagcaatcacgattccgagtaaacaggtgactaggccgccccatgcgccatatagaacgcctgcaattagctcaaccggctcgccgggaatgaatgcaacgataatttgaaaaatctggatgccaagtacgaccagccacccgccaaaaccaagtgaattgatccattcctgaaactgtgcttgaaaaaccgggtcggacagtttcgaaaagaagggcatacacagggctgtgatgatgccgatcagcgcaataaacaggatggcggcgccgcacagcagcatatattgttttctttcgtcgggtgaaagccgcttcatcggtttacccctttccttactttctcttaataaaacgaaatcagatatgaaatgacctcaaaaggcagaatgatcgccctgaccatcggaaggtataattgcccgtcaaaaggcggttgccgcgcaagcggcgagccgttgggcataaccgcggtataatatccgctttgcggatattataccacattttgtcggaaagatgtcaacgtattcgacaggattgcgctttgctttttttcaggaaatatagtatgatagaagaaacatctgaggatggaggtgacgcgcttgtatgaggggtttcgcgcgggggtggagccggggggcttgacaacagattatgaaatcaaaatgctgatttgttatgttctgagtgagctgggccgtcccatgccgatttccgcaatgatagaaacatttgtcggcgagggacttgccaactattttgaaacagcgagcgcggcctcggggcttgtaaaaagcgggcatattgcaattgaaacgtcagaggacaatgagcgttgttaccatgtaacagagcttgggatcggtacggcgcatacgtttgagaaaaacatcccggcatcggtacgtgataaggcggtgagcgcagcgcggcattatttcgtcatgaagcgccgccgcgcacaaaatactgtgacagtaaagcgtgtacaggatggatatttgatgacgctgacgattgccgatgtaggcagcgatttgctgtcaatgaccattttgctgccggatgagcagagctgtgatttggtgaaacgtcgttttctcaatgatccggttgttatttataaaggtgttgtcgcattgctgacaggcagctatgaaaatgttggagcgcttttggagccggcggaggatttgccgcggggttgacatgccttgtggaatcgtataaaatatttattcatgcaggatgtcctgagacatccaaaatggagggatgtcattgctcaaaaagctgatgttttggatcatggtcgttttgattgcgtgccggttcggcgcattggcatatatactgtcgacagatccgcaccgtctgccgcgggcggtttatatttcggccgggatcgtagtgatctatggtctggttttaattttcaaaaatattgtttcacgtgtttacaaaaaagaattggcatttttttatggagtcgccgctgccgcagttatatttaacctcatttttatgcgcatattcagccgcgttgaagtcgggattatcgattttcttgtcattggtacggtaatggacatgttgcttgatgtgatttttgttgtccttacgctgcgtgaaagccggtatgtccgcatcaaaatgggagcagatcattgatagcgatctggagaacccgctctaatgagcgggttctttcgggatatccgcactttacaagaataaatgtttgcggtaaaataatacataatagtgatttcacgtcaggggctgtttgaaaagttaaaattcccgtcttttcctacaaacagcagcaaatgctgcgttaaaaagtctcggaatccgaaaggattcctacattttttgccttgcattcttcttctgtttgcgaaaaatccggcagtctctctattttcaaacaaaccctaaaagcaagatataaaatgtgattgaaataatggaggcgcgaaaattttgaaactgcatttttccaagatgcatggacttggcaacgattacgtgtatatcaattgtttaaaccaaaagctgaaacatccggaagaaattgcgcgcattgtgagcgaccgccattttgggatcggctcagatggattgattctgatctgtccgtctgaccgggctgattttgaaatgcgcatgttcaatgccgacggttccgagggaaatatgtgcggcaatgggattcgatgtgttggaaaatatgtgtacgatcaggggcttacggagcgcacatccattcagattgaaacaaaaagcggcgttcgcagccttgatttaacgcttgggccggatggaactgtttcatctgtgcgggttgatatgggtaaggcgtcattaaaggcgaaggatattccggtggaaacagattatgacgattttatcagccagccgatgctggtacgcggcgaggtctatcttgtgacttgtgtttccatgggaaacccgcacgcagtcgtgttctgcgacgatgtcgataatttgccgcttgcagaaatcgggccgttgtttgaacgtcatgaaagatttcctgagggagtcaataccgaatttatccagttgatcgatcataagacgctgaaaatgcgtgtttgggaacgcggcagcggtgaaacctttgcctgtggaacgggcgcgtgcgcatcggttgcggcggcgatcgtcaatgagcattgcgattttgatgaggaaataacggtgcgtctgcttggcggcgatttgaaaataacggtacatagcgactattctgttctgatggacggtcctgccgttcatgtttttgacggggatatagagcttgatgcttgatgttatacagaaagggagcgatgctgattggcaaacctcaatgaacattaccgggatttaaaggacagctatttattttcggaaattgcgaagcgtgttgacgcgtttgcaaaagcgcatcctgaaaagaaaatcatccgaatggggatcggcgatgtaacgctgccgctcgcacccgctgtgacagatgcgatacatgctgcggcagatgaaatggggaaggcggaaaccttccgtggttatggtccggaacagggctatgcgtttctgcgcgaagccattcaggactactatgccaagaacggcgtcaagctgcaaagcgatgagatctttgtcagcgacggcgcaaagagcgacgttggcaatattacagatcttttcgcggttgacaataccgtacttgtaccggatccagtttatccggtttatgttgacaccaatattatggacggtcgccggattatttatatggatgcaaacgctgacaacggttttctgcctatgcaggatcgctcggtacatgccgatctgatttacctttgttcgccgaacaatccgaccggagctgtttattccagggagcagttggcggaatgggtcgcatacgcgctggaaaacagagcggtaatcttgttcgatgcggcttatgaagcgtttattggggatgaaggattgccgcacagcatttacgccgtgccgggagccgagaaatgcgcgattgagttttgttctttgtccaaaacggcaggcttcaccggaacgcgctgtgcatatacggtagtaccgcacgcattggagcagacggcggcagatggaacgcttttgtctcttaaccgcatgtggaaccgccgccaaacaacaaagtttaacggcgtttcttatattatccaacgcgcggcagcggctgtcttttccgaggaaggtatccggcaggcgcgcgaagcgatcgcctactacaaaggaaacgctgctgtcattgcaaagacgtttgattcgcttggctttcgttattttggaggattgcattcgccgtatatttggatggaatgtcctgacggtatgaaatcctgggacttttttgatctgttattggaaaaagccgctgtcgtcggtacgcctggcgctggttttggctcgaacggcgagggatatttccgtttgacgggctttggcagccgtggacagacagaggaagctatgcagcggatgcgggctttgcttggctgactgataaaaagaattggcgctgtgcagacggcgccaattctttttttaaaacgaaaaaatccgatcgcatcagcaatcggattttttcggcaaaactggcggagaaggagggattcgaaccctcgagacgctattaacgcctacacgatttccagtcgtgcgccataaaccgggctaggcgacttctccttgtaccgtgtgaatgtcactttgttattatatcacccatatcttaaaaaaacaaggggtttttcaaaaaatttttccaattttagcggatcgtgtttggacggctatacatataagcgaagcggcttgttacacagcggggattatgttaaaatgaatagataaccgggtacttttttgaggggagacagagaatgaaaagggaacggatttcgcagatggcagccgtgcttcacgcgccggtcgaacaggtttggaacgtcgttacagacaatacagattggagctggcgcagcgatctgtgtgcaatcaaagagaagccggatggcgttacctttatagagtatccaaaaaaaggttctgaaacggtattcaggattgttaaaaaagacccttatcggctgtatgcatttcatatggagcacgcaatgttcaccggagaatggacgggtgaattttccagagcgccttccgggggcacctgtgttgtattcacggaacgtttgcggattcgtaatcctgttatttggctgctttcgttcgcgctgatggatttacatggtatgcagcaacgatatttccatgatctgcgtgtgaaattgggggaaaaaagcgatggagaagcttgagatatttgattcgacgctgcgtgacggcgcgcagggggagggcgtttcattttccgtggaggataaactgcggattgccggggcgctcgaccgtgccggcgtcggcttgatcgaggccggaaatccgttcagcaatccaaaggacgctgaatttttccgccgtgccaacacagagctgcgtttaaagcacgcgcgcctggtcgcttttggctcaacgcggcggcgcggcgtcaatgtcagaaaggatcaaaactgcgccgcgcttttggcgtccggcgcgccatacgcggcggtgtttggaaagggctccgcctggcaggtgcgcgaagtgctctgcgcgacgccggaggaaaaccttgaaatgatttttgatacggtgcgctggctgacagatgcggggatggagacttttttcgacgccgagcactttttcgatggttataaggataatgcagagtatgcgatacgcacactgcgcgccgccgccgaagccggcgcgcgccggcttgtgctctgcgatacgaacggcggctgttttccggatgaaatagagcgcatcactgccgaagccaacagattatttccgggcatgatcggtatccactgccataacgataccgggtgcgccgtggcgaatacaatcgcggcggtgcgcgccggcgctcgccatgtgcagggtgcgtatacggggcttggggaacgctgcggcaacacgaacctgtcgactgtcatagcagacttacagctaaaattgggatatgactgcgttccagaggattgcattccgcgtatgaccggcgccgcccgtatgatttcggaaattgcgaatgtaagtctgccgcacaccatgccgtatgttggaaaaagcgcgtttgcccacaaaggcggtatgcatgtagacggcgtgaaaaagaacaccgccgcttttgagcatgtcgatccgtcgcttgtcggcaatcagcgccatattcttctgtcggatgtgtccgggcgctccgcgatgattggaaaaatcggcgaagtcatccccggactctccaaacagtcgcccgagctggatttgctgctcggcaagctcaaggagcttgagtatgccggctatcagtttgaagcggcgaccgcgagttttgagatggtggtgctcaaggagcttggacgctttcaaccgttctttacagtcgagctgttccggattattggagaacaggacagtgcaaaccggcatatggcctcagcgatggtcaaggtacgcgtaggcgatcgctatgaaataacagcggacgaaggcgacggaccggtccatgcgcttgaccgcgcgctgcgcaaggcgctggaggtattctatccggcgctgtccggcgtacatctgattgattataaggtgcgtgtgatggataccggacgcgcgacggcggcgcttgtacgcgtattgattgaatcgtccgacggggaaagcgtttggacaacggtgggtgtttcaacggatatcatcaacgcttcgcttcatgcgctcgccgattcgatcgaatataagctctatcgcgaccaagtcggagcatccaaaaagcagggagacggctgcggcgggtgagccgtattggctgccgctccaagcggccggatcgatgcttattcatgcagacggcccggaccaatggtccgggccgtctgcatgaatttactttttggagatcaggtccgccacataaagcccgtttgcagccgcttgcgaaagggagcgggtaaatcctgcgccgtcgccgatggcgtagataccggggcagccatcgacctcaaactccgtacacttgggacgagcggagtaatacttgcattcgatcccataaagcagggtgtcgtaattggctgtgccgggggcgatttgattgagcgcatgcagcgtttcaatgatattatcaagctggcgcttgggcatacacaggcttaaatccccggggacggcgcccagagtcggacgcacgacgccctggcgcagacgcttttcatctgttcggcggccaagctccaggtcgccgaggcgctgcacaagtacgctgccgccgctgatcagattggcaaggctcgcgacatggcgcgcatattcaatcggttccttgaacggctgtgtaaaattagtggttgaaagcagcgcaaagttggagttctttgttttgcgtgattcttcgcggtagctgtggccgttgacagtcagcacaccgtttgtattctccgtaacgacttgtccgcggtcgttgaagcagaacatgcggataatatcgccgtatcccttggagcggtaacggattttcggctcatagattttctttgcaaaatcttcccacaccattgaagggagttcaacacgcacgccgatatcaacctgattgttgtgcaggggaatatcgtttgcctcgcaccaatcgctgaaaaactgactgccggcgcgtccgaccgcgaagatgatttttccggcctgaaaagtcgattccccgttggcgtttctgactgtgacgtcatgcgtctgcttgtccacagccgtaacgcatgtattgggataaatctcgacgcgtttggcaagcgcctcaaccaaacgcttcatggtttcaaagtttgaatccgtaccgagatgctttaactgcgcctggctcatatgcagatcaaactccagacaccgctttttcagctcgttgctcggctgaaaccgctcatgcgtggcgccgaagctgacaagaatcgcgtcggcctgctcgatataatcgatgaccgtttcatccggcaaaaactctgtcagccatccgccgtattcggtgctgatgacatatttcccatcggaaaatgcgccggctcccgccaatccctccatgatggcgcacgatttgcacttgatgcatgtgccgacctttttggcgatgatcgggcagatacggttatcaagcgcatgccctttttcaaacagagccacggaaagagtgggggaaagctctgagatgcgccaggcggccatcaagccgctgatgccgccgccgatgattgcaatgtcgtaattctgcttcattttgacgattctcctttgcgtatgcgaaaatgcagccggaaccggcgcatgcgcaggcgcttgcgctgcttttgaatgaaggcgttgtgatagaccttcaggacatactgtgcaagatcgacggctccgctttgttcgacggaggcgcgtgtcgacgcgcgcaaggcgtccagccggtcggccggcagatcgcgcagcatttggattttagccgccatatcctgcgcatcggaaaaaatatagccgttgacgccgttccggacctgtccctcgttgagcggatcgacgatctgcaaaaccggcaggccggtcgccattccttcaagcatggaaatggaatttgtatcggaggtggaggttgtgatgtaaaaatcacacgcggcgacatacggcggcatatcttcatgcaggaccttgcctgcgaatgtcaccatctgatcgatgccgagcgaccgcgccagctcctccagctcggggcggacaggtccgtcgccgacaatcagcaggcggatatgctcctccggacggatcgcctgctgccagtagcgcagaaggatatcaacgctcttttcacgtccgagccggccgacgaacacgcccagaaagtcattgtccgtatagccgtatttttcccgaaaggcgcgtttttgttcttcgctgatgcgctgcgggttgaacatctccagatcgaccggattggggatgacgctgacaggcttgtaaacgcctgccttgcgaaaatactcctcacattttttggacggaccggttacagcctgcgccgatttggcaaacaattttgtatatttgtgcgaaaactttgttgttaaaggcacaagcggctgtggagccacataataaatgtactcgtcatacatggtgtgcagcgtatagacgagcgcaacccggaggatttttgcaatcatcataccggaaagcccgatgccgaattcgttgtgtacatggatgatatccggtcgaaaacgcgcgacatatttcacgcgcgttgttgacaaaggcatcgcgatatcatatccatagaaccgcttggaggtgcgcgcagggcaatgcaggatgccgtctgcgacaaaatggcgccgcgcgtcagcgtcggctgtcacgatcagcacctcatgtccgaggcgctccaggccgtccttaagggattttacgtgtgtcacaatgccgttgacatgcggaagatatgtttcagtaaacaatgcaatacgcatagataaaagctcctgtctcatttatcggtcagccgcctggcatccgtacatttgcggaatgtttcggcagttatccataaaacgaattcgggcacaacccgccttcaggaattttcaaaataagagataatactttctaattataccaagctttcttctggaaatcaaactttcttttcccataattggcaagaagcgtttgctaaaaaagtaaaaatgatgtaaactatataacgatactgagggagatcacgaaatgaggtgcgtcaaatgcctaatgatatgaaacgtaatttaaccatgctgaccgatttttacgagattacaatgtccaacggttactttcagtatggactggaggaccggattgccgtgttcgatatgttttttcgcaaaattccggatgggggcggtttcgccctgttcgccggactggagcagatggtcgaatatctaaaaaatttagaatttacgcaggaggacattgaatacctgcggagcaagggtattttcagcgagccgtttttggagtatctgcgccgtttccgttttacatgcgatgtctggtcggtccgggagggaaccccgatctttccgtatgagccggtcgtcattgtacgcgggccgatcattcaagcgcaattgattgaaacgatgatccttctcacaatcaatcatcaatcgctgatgacgacaaaggcaaaccgcattgtgcgggcggccgaggggcggccgatttcagaatttggctcgcgccgcgcgcagagctacgacgcggcgatgctcggcgcgcgcgcaacctatatcggcggctgcgcgtcgacggcctgcgccattgccgaccgcgaatatgggattccagccgtcggtacgatggcccatagctgggtgcagatgttcgacagcgaatatgaagcgtttaaaaattacgcgatggtctatccggatgacagcgtgtttctgattgatacctataacgttcttaaatcaggcgtgcccaatgcaattcgtgtcgccaatgaagtattaattccgcagggaaagcggctgaagggcgtgcgcatcgacagcggcgatatcgcgtatctctccaaaaaagcgcgtctgatgctggacgaggcggggatgcgggactgcaagatcatggcgtccaattcgcttgatgagtatattattcgcgacctgctactgcagggcgcgcaggtggattcattcggagtcggcgaaaatatgattaccagtaaatccgatccggtattcggcggcgtttataagctggctgccgttgaaaaggacggcgtgctcgtgccaaagatcaagatcagtgaaacaattgaaaaaatcacgacgccttgctttaaaaatgtttaccgcttttataaccgtgagacaggacaggcgatcgcagactatgtgactgtacgcggtgaaacggttgatgatacgcagccaattacgatcttcgatcccgtcgccacctggaagcgcaaaacaatcagcaatttccgtgcggaatgccttttggtacagatattcgaaaagggcagatgcgtttacgacctgcccgcgctcggcgatatccgcgcctactgtgccgcacaggttgacagtttgtgggatgaggtaaagcgatttgagcatccgcatcggtactatgttgacttatccgaccgtctgtggcgggagcgaaacgatcttttggagcatgtcagcgtggaatgatcgctcaaaaacaaagcaaaaccccggatcatgtgatccggggttttattatagaatatatcatatggcaacacgctatttacaaaaagcatgtggagctttttatgtaaattggacaattctaaaaaaattaagcaaaatgttccagtacagttgcattttccaggatatttgatataatgaagtgtatgcagtagatgtacatttgtatttctgccgctgaattccgacatggaaatgattggaggaaagattatgaggaaatttttagcgattgctttggcatcggcgctgactctttctatggcgtccggctgcaaaaaggtcgacgaaggctctccggctcctgcggccggatccgcgcctgcgggtgatgccgcggccccggccgcagacgcttcagctccatctgacagcgcggcttccggtgatgtgatcaagattggcgtgtttgagccgcagaccggtgaaaacggcggcggcggtttgcaggaggtttacggaatccgctatgccaaccagatgttcccgactgtcaacgtcggcggtaaggaatataagatcgagctggtcgaggccgacaacaagtccgataaaacagaagcggtcacggccgcgcaaagcctgatcagcgccggttgttcggtcgttctcggttcctacggatccggcgtatcaattgccgccggcgaaatctttgcggacgcgcaggtcccggctatcggctgctcctgtacaaatccgcaggtcacgctcggaaacgattactatttccgcgtctgctttatagatccgttccagggtacggtgatggctaactatgcggcccaggacggcgcaaagacggccgctatcatcacgcagctcggcgacgactattcgtccggtctgggcaacttctttaagaatgcgtttgtcgagcttgtcggcgaaggctctatcgttgctgaggaacagttccagacaaaccagaccgattttaaagcgatcctgacgaatatcaaggcagccaatccggacgttatcttcgcgccttcgtccatcgcgacggcgcctctgatcatcaagcaggcccgtgagcttggcatcactgcaaagattatggccggagacacctgggaaaacggttccatcattgaaaacgccggcgcggacgccgagggcgtcaccctgtcgacattctttgacgagggcgatacctccaaccaggtcgcggctgaattcatcactggctttaaggagtatctgaccagcattggacaggatgatatcattccggcggtttccgcgctcggttacgatgcatatctcgcggccatcaaagcgattgaagcggctggctccaccgaaccggcggcgatccgtgacgcactttcgaccctcagctacgaaggcgtgaccggcgcaatttccttcgatgaaaatggcgacgccaacaaggatatggcctttattaaagtgatcgaaaacggccagttcaaattcctcaaaacggttacactcggcgaataaaatataatagctgcaaggcgggaggcgtcttgtcctcccgccttgtattccctttaccgcgtttgtgtaggctgggactgttcgaagaataaaaaagcgacctttctgctgtacataaaggatttgtaatttccttttttatcgagtcctgcccgcttggaaaaccgtctgcctgcttgaaaattggcgcgctttcctgcggcgcctggatttaaccggcgccgctattcttgctatcgtttgggggcttcctgcttatgagcttgacaacaatcctgcagcactgcctgacaggtatatcgctaggcggcgcttacgcgctgattgccatcggctatacaatggtttacggcatcctgcgtctgatcaacttcgcccacggcgatattttcatgatggcaggatattttatgattttcgcaatggcaagcatcccttggccgattgccattccgcttgtcatactcgggaccgtcgttttgggcgttgtgattgaacgcgccgcttataagccgctgcgcaccgcgccgcgcatgtcgatcatgatttcagcaatcggcgtttcctacctgctgcaaaatttggctacatatctgtttacagcgattccgaagggatatccggaaattccttttctcaagcgtatcttcaagatcggcgatctgtccgcttcgcttgttacatttattacgccggttttgacgattgtattggtgcttttattgatggcgcttattaaccatacaaaggtgggtatggccatgcgcgccgtcagcaaggattttgaaacatcgcgcctgatggggatcaaaattaatacgattatcagtatcacctttgtgattggttctgcgttggccgcggtcggatccattctttatttcactgaccgtatgtcggtcacgccgttttccggcacgctgccggggttgaaatgctttgtcgcggcggtattcggcggcatcggaagtatcccgggcgctgtggtcggaggctttgtaattggtatctgcgaaacgctgcttgttgcaatgggctattctacattcagcgatgcgtttacattccttctgctgatcgtgatgctgctgttcaggccgaccggcttgttcggtgaaaaaagtacggataaggtgtgatgcatatgaaaaaatcaacaaagcgcatttgttctttggtgctgatcgccctggccgtcgtgctgctttttatactggacggacataaaaatgaacagggcatgctgatctctattttgcagaaaagcgccatcctggccatcgtcgctgttgcaatgaacctgctaaacggctttacaggcctgttttcacttgggcaggcggggttcatgtcaatcggagcgtatgtcacggcgattctgatgatcccggtcgcaagcctggacggcgtttactatatgaatggggtcgcgcctggaattcggtcgatgaaagaggcgatggaggctggccctgcgtggctccaggcggcatatccatttttggcgctgattgccggcggcttgatcgctgcggcttttgccgcactgatcggtatcccggtgctgcgtctgaaaagcgattatctggcgattgccacgcttggattttccgagatcatccgcgccgttttttccagcccgcagatggataccattacaaacggctcctatggccttaataaggtgccaaccttcccgaaactgtttggtctgccggttctgtttaccccgtttatcatcgctgctgtctgcatcgcattgatggtgctgctgatcaactccacctatggacgcgccttcaaggcgatccgcgaggatgagatcgcggcggaggcgatgggcgtcaacctgtttaagcataaacagctttcatttgtcatcagttcgttttttaccgccatttccggcggactgctcgcaatgtttatgcgctcgatcgaggcgaaaaccttcagcatcacgctgacgtacgatatcctgctgattgtggtcatcggcggcatcggcagtgtaaccggcagcgttttgagcgccttccttgtgactgcaagcaaggaatggtggctgcgtttcttcgatcagccgcttatcatcggcggatgggagatttcgctgttccgcacaggtttccgtatggtcgtattttcggtgctgctgatggtcgtcgtgctgttttaccgccgcggcctgatgggagataaggaattttcctgggatggccttgtgcgtctgttgaagaagccgtttgccaggcgtgtcccggccggcgtgaagggcggtgctggccatgagtaaaaatgtgcttcgactggaaaatctcaccatgcagtttggcggcgttgtcgcggtcaacgatctgtccctatcgattgacgagggggagattgtggcgctgattgggccaaacggcgcgggaaaaacaacggcgtttaatatggtgacgggcgtttatgcgccgacaaacggtgcgatttattttaatgatgagctgatggtgtccaatcatccgcagggcaatatgcgcaagctgtatcaggggaaccatgcggacaaatttccaaaagtgctggagcgcacgccggacgcaatcacgcgccttggaatcgcacgcacgttccagaatatccgtttgtttaaaagcttaagtgtttttgaaaacgtgctgattgcaaagcatatgcgcgccaaggctggcgtattttccgcagttttccgtcttaatgcgaaagaggagaaggtgatgcgcgaggatacgatgcgcctgttggatatattggagcttgctgatttaaaggacgaggtggcaagcagcctgccatacggcaagcagcgccgcctggaaattgcgcgcgcgttagcgaccgagccgaaaatgctgcttcttgacgagcctgccgccggcatgaatccacaggaaacagacgaattaaccgagttcattggaaacgtcaaagatgactttcatttgacggtgtttatgattgaacatcatatggacttggttatggagatttcggaccgtatttatgtgctcgattttggtcagatgatcgccagcgggacacctgctgaaattcagaataacaaccgcgtcatcgaagcttatctgggggtgcaggaggatgcttaaaatcaatgatctctgtgtgtcctacggcggtatcgaggcggtcaagggaatcagcctggaggtcccggagggaagcattgttaccttgatcggcgccaacggcgccggcaaaagcacaacgctgcgggcaatttccggccttgtgccgattaaaagcggaaccattgaatttcttggggaacgtattgacggcgtgccaagcgagaaacttgtcggcaggggaatcacgcttgttccggaggggcggcgcgttttttccgatctgacggtgctcgagaacattaaaatcggcgcctatctgcgcaaggatgatttgactgatgatatcaactgggtttatgagctgttcccgcggctcaaggaacgttcctggcaggcggccggcacgctttcaggcggcgagcagcagatgctggcggtggcgcgcgcgcttatgagccgcccaaagctgatgatgatggatgaaccgtcgcttggtttggcgccgctgattgttcagggtatttttgatattattaaagaagtccataaacgtggtgtgacaattcttctgatcgaacagaacgccaatatggcgctgcggacggctgattacggctatgtgctggaaaccggcaaaattatcatgcaggataccggtgcggccctgcttgcgaacgaggatgtcaaggcggcgtaccttgggaaaaaacgctcctgagaaggtggttgcgaaaaaatccggctccacaggcttgccgcggggccggattttatttgttgcatttttcggcaagtatgcaatgggcgcgcgggcgtttaaattgatgcaatttgtattgcaggctgaacgttcccgttgtataattttgcttaagaatgaaacgggtgcaggaggtgtgttatgaagcattatcaactggggctttatgaaaaggctatgccggggacgctttcctggcgcgaaaagctaaagaccgctaagagagctgggtttgattttgtggagatcagtattgacgaatcggacgagaagcttgctcgccttgatatgagcacggctgaacggatggctctggttcgggagatgtcggaggcgggcctgccgattcgttcaatgtgtttaagcggacatcgcaaatatccgcttggcagctctgatccggcggtttgcacacgcagtatcgaaattatggaaaaggcggttaggcttgcggcggacctcggcgtccggatcattcaattggcggggtatgatgtttattatgaggattccacaccggatacggctgcgcgttttttagaaaacctttcttttgccgcaatgctggcggcccaaagcggcgttctgctcggattcgagacaatggaaacgccttttatgaatacagtggagaaagcgatgcgctatgtcaagctggttgattcgccatacttgcaggtctatcctgacgcgggcaatctgacgaatgccgctgttgcgagcggctcggatgtttgcgccgatttgcgaatgggcgcaggtcatttaatcgcaatgcatttaaaggaaacgatgcccggcgtattccgcgaagtcccgttcggtacaggtcatgtcgattttaaaacgcttataaagcaggcttggagccttggggtacggcgctatgtggctgaatgctggtacacaggcagcccggattgggaacaggatctagccttagcgcaaaagcttttaagcggttgtctgaacaaggaggatttgagatgttagaaacgctaaagcaagaggtatttgaagcgaatatgcagcttccaaaacatggcctgatcacatttacgtggggtaatgtttccggaatcgaccgcgaacaggggttgatcgttatcaaaccgtcaggtgtggaatatgacgctatgaagccggaggatatggtcgttgtagaccttgacggcaagcgggtcgaaggcaggcttaatccctcgtcggatacgccgacgcatgtggagctatataaagcgttcgggaacataggcggagtcgtgcatacgcacagccgctgggcgacgatctttgcacaatgcgggatgggaatcccaggctatggaacaacgcatgctgattatttttacggcgagattccctgtacacgccgtatgaccgcggaggaaatcaaaggcgcatacgaaaaggaaaccggcgccgttattattgagcggtttgctgatctgagcccggacgatatcccggccgttctggtgcacagccatgggccgttcgcctggggtacagacccgatgaacgcggtgcataatgcggtcgtgcttgaggaagtcgccatgatggcctggcattgcaaggcgctttccggcaatatgatcgaaccaatgcagccagttttattggataagcattatttacgtaagcatggcgcaaatgcatattacgggcagcggtagtatgcgggtataggctggatatgattggataagaaaggggagggcggcgtgtatacctgtgccagatgcagtattcatgcatgcagtgaggagcatccgcagcagatgccgaaaaattgtcctatgcatcagcatgcattgctaagtgaggcgcttgaacagtatcaaagtcctgaaaatcacaacttttacatcaaggcgtctgaaattgaagcgattggttacggccaatgggtccggctcagggagacggttgaactatgtaaatcgatgggctacaggcgaatcgggatggcattttgccgtgggctgagaaacgaagcgaaggtgatagacggcctgctgcgccgtcatggctttgaagttgtttcagtgatctgtaaaacgggcggtatttccaaggaaaaagcgggaattccggaatcgggaaagctgaagccgaatcaattcgagccgatgtgcaatccgattgcgcaggcccggctgctgaatgagcagaatacgcagttcaatattgcggttgggctgtgcgtggggcacgattcgcttttttataaatattccgacgcgctggttactacgctgattgcgaaggaccgtgtgctggcgcacaatcctgccggagcggtttattgtgcggaaggctattttaaagcgaagctggagccttaaaatgaaagcaggacgccatgcggagtcctgcttttttgtacgatttgcacatatcgttttacaagattgtcaaagttaaaacccttgctttacagatactgattcatatccttttcgtgtcagtataaaaaagattttttgaggatttcggagtaaaacagagaatattaaaaaaataaataaaaaaataaagaaatttaacggcagaagcttaaaaatcgcgaaaatagcttgactttttacagtaatatgatatattgattcttgcagtttttgcatctgcataaaatcgatgacaatttaccgcctaataacgggcgcgtataaaaagcgcgctgcgattagaaaaaaccttttgcgggtaagcggtaagaaatcatcgggggccgtaaagacggcctaaattccgcaaagggggatgcataaatgaaagaaaacaacattgtaagcctcagagacatttccgttgatttcgatggcgaccccatcctcgtcggacttgatctcgacatccgtgacaaagaattcgttactctgctcgggccgtccggctgtggaaaaaccacaacgctcaggacgattggcggtttcgtcagtccgaagtcgggtgacgttttttttgacggtgtgcgtatcaacgacgtgccgccgcacaagcggcatgtcaacacggtgtttcagcgatatgcgctgttcccgcatctgaatgtttttgaaaacgtggaattcgggctgaaaatcaaaaagctgcctgaaaatgagcggaaaaaccgtgtgcatgagatgcttgagcttgtcaatctcgcaggctatgaccggcgcaatgtcaatcaactgtcaggcggccagcagcagcgcgttgcaattgcgcgcgccctggtcaaccatccaagggtgcttttgctggacgagccgcttggcgcgcttgatctcaagctgcgcaaggagatgcagattgagctgaaacgcatgcagcaggcgcttgagatcacctttatttatgtgacgcacgaccaggaggaagcccttaccatgtcggatacggtcgtcgtcatgaatgacggcgacatccttcaggtgggtacgccccaggatatttataatgaaccgaaaaatgcgtttgtcgccgactttatcggcgagagcaacatcatcgacggcgtcatgcataaggattgcctggttgaattcgcagggcgcaagtttgactgtgttgacagcgggtttggcacgcttgaacgtgtcgacgtagtcatccggccggaggatatcaaaatcatcgagccgcaggacgcgccgatctccggagttgtcgagtcggtgatcttcaagggcgtccactttgagatgatcgtcgatgcgcatggctacaaatggatgatccattcgacacgcagcgagcagccgggcgccttcatcggaatggaggttgctcccttcgatatccacatcatgcataagatggaggtggagtaatgagatcgaaggcgaccgcgtttccatatttgatctggatggtgattttcatcgttgttccgctcgcacttgtcgcgtattatgcggtgacaacgccggaagggacattcaccatcgattacatttcgcaggtcggagaatatacgcctgtattggtacgttctgtatggcttgcattcatcgcaacggtgatctgtctgttaatcgcctatccgttggcattcatcatatcgcgccacaatggcaatggacagcgcacgatgatcatgctgattatgctgccgatgtggatgaactttttgctgcgtacctatgcatggatgacgattctggaaaaaaacggcctgatcaaccggatgcttggatattttggaatcggaccgcttgagatgatcaatacacagggcgcggttgtgctcggtatggtttataattatctgccttttatgatcctgccgctttattctgtaatgacaaagattccggacagtgtcattgaagccgcgcaggatcttggtgcaaacgcgtccaaaatcctgatgcgcgtgctgatcccgatgacggtgccaggcatttcgaccgggattatcatggtgttcgtgccatcggtttctaccttcatcatttcccggatgcttggcggcggcgggaatctgctgatcggcgacctgattgatttacaattcttgggtaatgcctataacccgaacctcggcgcggcgatcgcgcttgttctgatggtattgattctgctctgtatgagcattacaaaccagttcggagatgaggagaagggggatttgctcaaatgaaatggctgcgtaagacatatgtcgccattgtgatggcatttctgtatgcgccgattctggtgctgatcgtcttttcctttaacaagtcaaagtcgcgcggcgcctggacgggcttcacgctttcgtggtatcaacggttgtttacaaacgaagcgatcattcagtctttgatcaacacgcttgtggtggcgctgatttcatcggtgctggcgactgtaatcggtacgcttgccgcgattggtatccgcaatatgggacggctgtcccgcagcgtcgtcatgaacgtgacctacatgccggtaatcaatcctgaaattgtaaccggcgtctcgctgatgctgctgttcgtattcgtcaaaaacgccggccttcaattggaatttggatttgtaacgctcgtgctcgcgcatattacgtttaacatcccgtatgtaattttaaacgttatgccaaaattgcggcagatggacgtgtcgatatatgaagcggcgcaggatcttggatgcagccccatgcaggcgtttttcaaggtggtcattccagagattatgcccggtatcctggcgggatttttaatggcggttacgtattcgctggacgactttattatcagctattttgtcacaggcccgacgtcgcaaacgctgccaatcaccattttttcgatgacgcggcgcaaagtcagtccggagatcaacgcgctctcgacaattatttttgtcgttgttttgattgtgctgttggccgttaacctcaacgacgcgcgtcgtgagcgtgaaaaccgggtgaaagcgagggcgcgcgtatgaaaaaattaagtgcgtttctgcttgcgatgttgcttactttttttatgtccgtatccgtcttggcagaggtttccgtggaggatgaaagctactacacccggtttcagggggaggggcgttctttgaacgtccacaactggggcgaatatatttccgacggttcggacgggagcatggatgtgatcgccgaatttgaggcgttgaccggtattaaggtcaattacaccacgttttcgacgaacgaggaagtgtatgcccgcttacgcaatggaggagccagctatgatatcctgattccaagcgattatatggttgctcggatgattcgggaggggatgcttgaaaagcttaattttgacaatattccaaatttcaagaacatttccgagagcttcctcaatccaatttttgatcctacaaacgaatactcggtcccatatacctggggaacggtcggtgttatctacaataaaaccatggttgacgaggaggataccggcagttgggacttgctgtggaatcaaaaatatatgggcgatattttgatgtttgccaatccccgcgacgattttggcattgcgctcaagcgtctgggatatcctatgaatcctgaaaatgagcagcagctacgggaagcaacggaactgctcaaggatcagaagatgcttgttcaggcgtatgttatggatgaaattttcgacaagatgatcggcggtgaagcggcgattgctccgtattatgccggcgatgcgattacgatgatggctgacaacgaagacctcggctattttgttcctgaagaagggaccaaccgttttgtcgacgcgattgtaatccccaaaggctcaaaggaaaaggaatgcgccgaaatgtttatcaactttctgttggaggcggaggtcggcgcagccaacgctgagtatattggatacagttcgccaaacgacgcgtcgcttgcgctgcttccagaggatgtgcgcaataatccaattgcgtatccatcggacgaggtgattgcaaagacagaattttggattgatttgccggcggaaatgaaccttgccgtcgacgcggcatggacagagcttctgtccacggatgtacagtacagcaagtggctgatgcctggtatgatggccgcggcgctgcttacatcaatcggtattaatgttacacgcgcctggcgccgccgacgcgagcgcgaggacttgaacagcgaggttcccaagcggctctgagccaccggtaaaggggcggcgctttgcccctggagatgtctgcgaactatggacagggtgatacgcgggcgcagccctctgccgccctgatggccgattttatcatgccgctttgcggagatgataaaatggcggggatgcgattgcatccccgccatttttttggcgtttagctggatttatcagcagcagcagttgttgttgcagccacagccgcagtcgttgccgcagccgcagtcatttccacagcagttgttgttgccgccccagccgaagccgctgccgccccaaccccatccgaagatgatgatgatcaggatgatgatccagaagtagttgccgccaaagttgttattgcatcccataaagaatgacctcctaagagtgatttcatcccatactatgtcgccggcccaacttcggttccttgtgatgatgcgcatatcgcggctgacttctgacaatattattattggaaggcgcataaagataatttggggtgatacattgtttaaatttaacggttttacaccgaaagcaaatgctgcaatcaattgtgcgattgacgaggcgtcggccctcggacacacatatatcggcagcgaacatcttttgctgggcctgctttcggaggggagcggcgtggcgttcacagtgatgcaaaaaaacgatgtcagcgcggaaaaagtgcgtgaattgctggttaagacggtcggaaaagggatacgttcggtattgacgccgtctgatatcaccccgcgctgtaagcggattttggagctttccttaatgcaggcgcgcatgggaggcacgcccctggcgggtacggagcatattcttatgaatttgctcaaggaaaatgagagctatggcgttcggtttttaaaacagctcaatgttgatccggaaatggtcgccaggcagatcggcgattttgcgcagacctgcggagccgatctgctcggtgcccggcgggccgcgccgcccagacctaaaacgataccgcgcacgccgctcattgagaaatatgggcgcgatctcactgaaatggcgcgtcaagggaaaatagatccagtgatcgggcgtgaaaaagaaatagaacgtgttttacagattttaacgcgccgtacaaaaaataatccctgcctgatcggagaaccaggcgtcggaaagactgcgatcgccgaagggatcgcgcgacggattattgaacgcgatgtgccggcacagctgcgcgataaacgctttgtcgcgcttgatctgacttgtatggttgcaggtacaaagtatcgcggcgattttgaagaacggattaaaaacaccattgacgaggttatcgcggcaggcaatatcatactgtttatcgacgaactgcatacgattatcgggacaggcgcggcggaaggcgccgtcgacgctgccaatattctcaaaccgcagcttgcgcgcggcgaattccagttggtgggcgcgacgacgctcgacgaataccgcaaatttattgagaaggacggcgcgcttgaacgccgtttccagagcgttttggttgaggagccgacagaggaacagtctgtacaaattatccgcggtctgcgggaaaaatatgaggcgcaccacaaaatacgaatcctggatgaagcgattgacgcggcggtatcgctttctgcccgttatattgccgaccgccgcctgcccgacaaagcgatcgatttgattgacgaggcgtgctcgcgtgtgcgcatgaacgggagcacggtgccaaataacctgcgcgagttggagagccgtatcagcgcactgcgtgaggagaaggagacggcgatcagcacacaaaattttgaatgcgccgccagtatccgggatcgtgaaagtgatctgcgggtaaagctcgagaaggcgcaaaatgaatgggaatatacagaaaatggaggaatgcgccgcttgtgcgccgatgacatcgcgcatcttgtctccaatattaccggtatcgatgtgacccgtatcacacaggcgcagagcgaacgtcttctgcaccttgaggaatcgctgcacgagatggtcgttgggcaggatcaggcggttcatgccgttgcgagcgcaatccgaaggtcgcgcgtcgggctgcatgatccatcgcgtccgctgggttcgtttatttttcttggaccgaccggcgtgggtaaaacagaactctgcaaggcgctggcaaaatgtatgttcggcgatccgcatgcgatgatacgactcgatatgtcggaatatatggagcggcacgccgtatcgaaacttgtgggttcgccgcccggctatgttggatatgatgagggcggacagcttacagaaaagattcggcgtcggccgtattcggtgcttttatttgatgaaattgaaaaggcgcatcccgattttttcaatatgcttcttcaaattttggaggacggcgttctgaccgatgcacagggacgcgctgtaaactttaaaaatacaattatcatcatgacatcgaatatcggcgcgcagatgctgcgcgatcaaaaccggcttggattttcgtcgggggaacaggattttgataaacaacaggagatcattcgcaaggcaatgcttgcggaactaaaaaaatccttcaaaccggaatttatcaatcgtgttgatgagatcattgttttccacaagctcggccagaaggaaattaaaaagattaccagcaacatgcttgacgcgctgaaaacgcgcctggcaggtttgcagattgaaattagttttgatgaatcggcggcggaacgcatctccatcgatggttttgaccccgcatatggcgcacgtccgctgcgccgtgctattcaatccaatattgaagataagttggcggacgaactgctgcatggcaagtttaaggcgggggataaaatcacctgtacctggcagaatgagcaatataccttcagctaaaaagttcccggttatatcgcggtcattgcggtatggccgggatttgtgctataatatgggcagtgcaaatggcaaagccctttgcagccgccgtctggcgcaaagcagcgggccgcgcatgttacactacagccggtgcgaagccggattgagtcaaccgttcggcgcttggcgggcaatcattatgtaattaaaacagaatggagaaattttgacatggctgatgaaatcaattctatctcgatacaggtggttcccgaacatctggcctgcgccgttggaagcggtgatctggatgtacttgccaccccaatgatgatcgctgcgatggaacaggccgcgtgcggcctgcttgcgcgttttttagaaccggggcagacatctgttggaactgccattgatatcaagcatacagctgcaacgccgtgcgggatggcctatacggcatcggcgcgtctgactggcagggaagggcgctgtgcgtcgtttgaggtgtgggctgaggacgagataggggaaattggacgcgggagccatacgcgtgtagttgtagacgcgaaacgctttcaggagaaagcggatgcgaaacggaggctgaatcaatgatcaagctggttatattcgatttggacggcacactgcttaatacaatcgatgatctggctgccgcaggcaaccatgtctgtgcagcgcatggctggccgacgcatacctccgagcagtttcgttattttgtcggagacggcgtctataagctcatagaacgcatgacaccagccggcgctgctgaaacaccagaaacggtacaatgtctgcgtgatgagtttaacgcttattacaacagccatagctgcgatctgacggttccatataccggagtgcctgaactgcttaaaaagttggatgcacgtggaattgcagcggctgtcctgtctaacaagccggatgcctttacacagcaattgtgcgcgaacctgcttggggggcggtttgccgttgttcacggccagcgagagggacgcccgacaaagcctgacgaaagtctgacaagggaaatccttttacagacatgtgtgcggcccgacgaatgtatttatgtaggcgattccggtgttgatatgcgtacggctaaaaatggaggcctgttcgctgtcggcgcgctgtggggattccgcacacgaaaagagcttttggaaaatggggccgatgcacttgccgacagtccgctcgacgtgcttgaatatatcggttgaaatgttgccgccgcgccggcttataaaaattttcttgacaaggcgtcttgaatggtgtatgataatgccaatatttctgaaagacaaagacggggacggcaaaaacatagttttgtccacagagagccagcgtttggtgcgagctggcggcagacagttttttagcttatcacccctgagtcgagcgccaaacacagcagtcagtaggcgtctccgctggacagcgttatttgtcgggagcttgttggagctttgctaagcggcgcttgacgcgcaatccgggtggtaccgcgggtttgtttaatcagactcgtccctgtttggggacgggtctttttgttgttttattcataactacaatgatggaggaatcagtatgcaggaacaaatgattatggagatcgcgcagcgtattcgcaccctgcgggagattatggaaattccgatagctgaaatggcgcagcaaacaggtttgtccgctgacgaatatgttgcttatgagcagggacagggggattttacatttacatttctttataattgtgcgcaggcgtttggcgttgacatcattgaattgattactggagacgcaccgaagctttcttcctattcaattgtacgtaagggagaggggctcgatattaaacgccgcaagggatttacttataatcatcttgcataccgcttctctggaaagatctcggagccatttttggtaacggcgccgttttttgaggaagaacagtcaaagccgatccacctttccgaacatgacggccaggagttcgactatattatcagcggaactctgaaaatgcaaattgatgaacatgtggagtatctgcatgcaggcgacgcgatttactatgattccggccataagcatggtatgatagcggccgggggcgagccgtgtgtatttttggcggttgtaatgaaggatgaaagcagcaagggggagcgtaactgatggaaatggaaaatttttataaacggttttgccgtgaggcatttgatgacaacggcgttctctgtgcgtttgagccggtggtggcggatgatttcaattttgcctacgacgtggtagacgagatcgcgcgcgttgatccggatcgccgcgcgatggtctggtgcaatgtggcgggtgaggaacgcacgtttacgtttggcgagatgaaactgtactccgacaaatgcgcccaaatgctgacggatcacggcgttaaaaaaggcgatatggttcttctggtgctcaaacgccactatgaattctggttcacggtgctcgctctgcataaaatcggagcagtcggcgtgccggcaacgaatctgctgacgacgcacgatcttgtataccgcttcaaagcggcaagcgtgacagcctgcgtctgttccggcgaatgcaatatcgctgaatatgtcgaggaggcgtgtcgggaatatcccgatatccacgccaagtttcttgttcgcgggacacgcgaagggtggcttgattatacaaaagaacttgagaaatatgacggcgtctggcaacgcgcccagacgcacaaggacgacccaatgctgctctattttacatccggcacaaccggaatgccgaagatggtcgtgcataacatggcgtatccggtggcgcacatcatcaccgcgcgctattggcacaatgttcacgaggatgatctgcatctgacagtgtcggaaaccgggtggatgaaggctgtatggggcaagctgtatggccaatggctggcttgcgcatccatttttgtttatgactttgataagtttgtcccgcatgatctgctgcatatgatggagaaatatcgtgtcacgaccttctgcgcgccgccgacaatctaccgctttttcatcaaggagggcatggagggatacgatctctcgtcgcttcgttattcgacgacagccggtgaagcgctcaaccccgaggtctataaccgctggtatgagtttacgggcctgcgcctgatggaatcgtatggacagacggaaacggttatgcaggtggccaactttgtcgggacaacgccgaaacctggttccatgggcaaaccctcgccgatttatgacatccatctgatcgatgaggacggcaatgacgttccgcgcggtacagtcggtgagatcgtcatcaatacggaaaaaccgcatcctggattgttcagcggctattaccgcaatccgcaggttacggctgaatcgtggcacgacggctattaccacacgggcgatacggcctggatggatgaggatggatatctgtggtatgtcggacgtaccgacgatgtcatcaaatcgtcgggctaccgcatcgggccgtttgagattgagagcgtgctgatggagcaccccgccgtgctggaatgcgcggtcaccggcgcgcccgatcctgtccgcggcattgtggtcaaggcgacgatcgtcctgacgaaaaaatacgagccgtccgaggagctgaaaaaggagcttcagacatacgttaagaagcagaccgcaccgtataaatacccgcggattgtcgaatttgtcacagagctgccgaaaacgatctcaggaaagatccgcaggacggaaatccgtgcccgcgacagccagaaataactaaaaaatgcggccgttttcatggtgaaaacggccgcatttttttgtttacgcacattttgggcctgtcagacatacatttatttatatgcaggagatggaagggggcggcgcccgtgccgattacaatccgtgtcagcaaacggaaactgcgcgcatggaagatgctgctgacgggggcggcgattttggcaggcgcgctattattgggcggacgcgtgcggccggcgattacctcggtctttacttatcaggcgcagttagccgcgacgcgctccgtcaatgacgcggtgctcgacgtgatcggacggggcggcgttgactaccagtcgatcatccatgtgcgcgaagacgcacaggggcgcgttacatttcttgaaacggatatgacggctgtaaaccgcttgaaagcggagattacaaacgccgtgtccgaccgtttgaatttggatgcgcaaagcggcgtcaaaataccgatcggcacattgcttggaggacagttcctttcgggacgcgggccggacgtgacgttccgggtcattccgcagggatatgcaaaaacggatttctataatgcgtttcaggaagcgggtatcaaccaaacgctgcatcagatcatgctgcgtgtggaggtgccggtgagcgccgtcatgccgacgtatactgtggatacagttgtgtccacagaggtatgcgtggcggaaactgtaattgtcggagatgtaccgcagtcgttcacggaaatttcaggcgaccatcgcggcttgcttgataaggccggcgactatgccctcaaaagcagtggattgcctgaggaaaatgtgatacaataagcgcagtggaaacgacagagccgcttgcagccgccattcggcggtaactgctgtaagatggcagactgcgcatgttgcgcaacgaaaaccggctttgccggttttgctgccgctttgcggcagacgattcagtttggacgtgctgctgcggtacaataaacgatagaattcctggcgctgccagcgtcacagtgtggaggaaatgatgggttgtaaagatttggaatctgcgaagcgccgtgtacaggagctgcgcacggtcattgaaaagcataatcacagctattatgtgctcgaccgtccgactgtcagcgattatgaatatgaccggcttctgcacgagctgattgatctggaggaagcgtttccggagcttgcgagcgaccattctccgacacggcgtgtcggcggcgcggcgctcaacacatttgcgcctgtgcgccatgaggtgcagatgggttcccttcaggatgtgtttgatacggccgaactggaggcgttcgacgcgcgcgtgcgcgaacagatcgagcgtccggtttatatcgttgaaccgaagatagacggactttcggtcgcgcttgaatatcaagacggcgtatttttccgcggctccacgcgcggcgacggtgttacaggcgaggacgtgtctgaaaatttgaaaacagtgcgttccatcccgatgacgctgccggaagcgctgccgctgatcgaggtgcgcggggaggtttatatgccgcgctccagctttgaacgcgttgtggcgcgccagcttgaaaatgaggaggagccgtttaaaaatccgcgcaacgcggccgccggctccctgcgtcagaaggacagccgtgtgacggcgcagcgcgggctggatatttttgtcttcaatattcagcgtatcgaggggaaaacgctgtcgggccataaggaatcgctcgattatatgaaaagcctcgggttcaaggtgattccgtcgtacaaggcgtttgacaatatttccgatgcgattgccgaggtggagcgcatcggcgcgcagcggtatgaattcccgtttgatatcgacggcgccgtcattaaggtggatgattttgcacagcgtgaggcgctcggcgcgacttcaaaatttccaaagtgggccgttgccttcaaatatccgccggaggagaagcaatctgtgctgcgcgatatcgaaatcaaggtggggcgcacgggcgcattgactccgactgctgtttttgagccgattacgctggccggcacgaccgtcagccgcgctgtgctgcacaaccaggatttcatcaatgaaaaggggatcgcgatcggcgatacgattgttgtgcgcaaggcgggagacatcatcccggaggtcgtctccgtggcaaggcaccagccagacgcgcccgtctatcaaatcccggctgtatgcccgtcctgcgggagcacggcggaacgcgaggagggcgaagctgtgctgcggtgcgtcaatatggcgtgccccgcccaggtcgcgcgcaatctgacgcattttgccagccgcgatgcgatggacatcgacggtatgggtcccgcaatcgtgcatcagcttttggcggcgggtctggtgaagtcggccgccgatctatacagtctgacgcaggcgcagcttgccgccctggagcgcatgggggagcgcagcgcgcaaaatctgatcgcggcgcttgagcagtcaaagtcgcgcgatttggcccgactgctgtacgcgctcggaatccgtgggatcggccagcgttccgcgcagcttttggcgcagaggttcggcacgatggacggcgtgctcgctgcatccgtggaggagatcgcgcagatcgacggctttggaggcatcatggcgcagaatacggctgattttttcgcgctggagccaaaccgcgccctgatcgaccggctgcgggcggcgggacttaatatggcctgcacaagtgcgccgacagcggacacgctctccggaaagatctttgtactgaccggaacgctcccgacgctgacacgcggcgaggcaaaggcgatgatcgaggcggccggcggcaaagtaagcggcagcgtctctaaaaagacggactatgttgtcgccggcgaggaggccggcagcaaattgcgcaaggccggggagcttggcgtcgcagtactggatgaagccgctctgcgcgccatgctggaggcatagagtggccggttcggatcgggtgatcctgcatgtcgatatgaacgcattttacgcgtcggtggaggcgctgtaccatcctgagacggccggaaaaccgatggccgtctgcggcgatgcagaaagcagacgcgggattatcctcgctaaaaacgagctggccaagcagcgcggcgtcaaaacggccgaaccgatctggcaggcgcgtcgcaagtgtcctgatttgctgctgctgcccccgcaccacgatctgtaccgtgcatattcaaaaaaggcgaatgccatctatgagcggtatactgatcttgtggaggcagcgagcgtcgacgagagttatctcgacgtaacgggcagccggaacctgtttggagacggtgttcagattgccgacgcaatccgcgcggcagtcaaggcggagcttgggttaaccgtttcggtcggagtttcgttttgcaaggtgtttgctaagatgggcagcgactataaaaagccggatgcgacaaccgctgtcacacgtgacaattaccgggatatcctgtatccgctgccggtgcgggatctgctgcatgtgggcggggcgacggccgccgctctttcagggcttggcgttaagaccatcggcgatctggccgcgcttgatgaacagacgcttaaagcgcgctttggtaagcacggccttgtgctttatacgtatgcgcacggacttgacagcgacccggtcaaggcggcaggggagcaggatgaaatcaaatcggtcggcaattcgctgacttataagcgcgacctgcgcaccctggaggatatccgcatcggactgatgccgcttgcggagtcggtcgcgtcgcgtctgcgcgcgcacgggctgcggtgccggggcgtgcaggtcgcaatcaaggacccgtccctgaaaacgattgaccggcaaatgcagctgccatatgcgacgcatcttgcaaaggatctgttcgatgcgtcgatggagcttgtcagccgttcatgggaggtagggcgcccgatccgcctgttgtcggttacggcgatcaacctgacggatgcgggagccgaggagcagttgagcctgtttgaagcgccgcgcgacaccggcaggcaggaggcgcttgagtcgtcgctcgactccattcgggaacgattcggcaagagcgcagtgacgccggccgtgcttttaaaaaatgaccttgggatcaagacataagcagacaagagggaacgatggtttattttaccgcgggtgcgcgataacgcactttattttgtttcactacccagctaattataatgagctgcagcggttcaaccggattttgcggtataatgccggtgtggacgcgaacaatatggcgccggtcagtgcaggagaggtcgcagctttcttcagcggcttgacagcattggcagatggacgccgatagataaagtcggaaggcgttcgcaaactgctttgcagcttgcgaacgcttttgcatatccgccgccttgacatagcgtcatatccgatcatccgtatgcataaaaataaagggaaaccaaattgacggggaggtacaacgcgatggtcgaggaaaaaaagaaagcaggaccgcacaacgtcgtgatggaggaccgtaagcgtctgacagtgacaggtgtgacagagatcgacagcttcgatgagcagacggtggtgttgttttgcgacaccggggagcttgcgatccggggagaaggacttcatatcaatcgaatcgatgtggacgcaggagaattgaacctggaaggcgtgcggatcgatgcgctttcctacgcggataatttgccgtcgcgcggcggcatatggggcaagctgttccgttgaatatctacaaaacgcagggcggggggattgcatggagatcacggtcgcggggcagacctggatatttttgatgtccgttgccctgggcgcagcgcttggcgttttatacgacgtattccggatcgtgcgtatcgcggtgcgcacgccgcccgctgtcgtgcttgtggaggatcttgcattttccattgtttgtacaaccgcgacgtttctgtttttgattggcgcggataaagggcagctccgcatgtttttgctgattggggaggcaagcggtttcgcgttatattactgcacggtcggtaccttgatcataggcgcagcgcgaggaattatcgctgtggtaaaaaggatatgtacgtttttttggaagctgctggtgtctccaattctgcgctttttggaaaagtttggattactaacaggaaaaattgcaaaacaattggcaaactgtctaaaacatcccgcagaaaattcgaatttgcccttgaaaaagcacagtgggatattgtataatttaagaaatcgactgcatagatgtggacagagaaaaaagaaggaaaagcaggagcataccggttcatgaaaaagatacatacaagaaaaaagagcttaatgatccggctgtgtgtgctcgccttttcagcctatgtggtcgtcagtttggtgtcgcttcaaatggagatcgccgaccggcgcagcactttggcgtccataacggagcaggcagagacacagcgtttggccaacaaggagatcgagcggcagatcgcccttggcgacgacaaggattacctcgcgcggatcgcgcgtgaaaagctggatatgggacgtgcggacgagcgtgtgttccgcgacgcggcaggcacctgatgcggctgtgcctgaaaaagggcggcgcgtgtaaaaatctgtttgggtgggctgttttgcagccttgtataaaacacaagacttttaaggaggcagcgtaaaatttatgcagcttgaggttggcagcattcttgagggcagggtgaccggaatcacaaagttcggcgcattcatcgaactgcctggcggcaaaaccggaatggtacatatttcggaggttgcgtcgtcgtacgtgaaggagattaccgattacctgtccatgaaccagatggtcaaggtaaagatcatcgggattacgccggaaggaaaggtcagtctgtcgataaagcagacggcgccggcatcgccgacccaggacaggcagcccgcgccccgcgctttgcgcggacagggcggcgaccgccctgcgcggccgttccagcgcagagcgccgcgcgaagtttcctacggttttgaccggcgtcagccgatcacaaatgaaaacatgtcgtttgaggacatgatgagcaaattcaaacaggccagcgatgataagatgtcggatttgaaacgctatacggacatgaagcgcggttccgcgcgcaatcgtccgcgctgagaagcgcgtttcgcgcgcggccagtctgtaaaaaagggcgctttgcgccctttttttgcagctttgagaacctgacgcggcaggccgcagaggattgcttaagtgaatgggacggacgtggaagtgatgggcggcttttgccccaatggaaaggaacatttatgctgatcatcaatgcaaatatccaaacaatgacggggaacgattataaaaacggatatatcctgatggagcaaggtaaaattacggctgtcggcgatatggcgcaggctccaaaggcggattgcctttacgatgcgcacggcgcgtttgcgcttccaggcttcatagatgcgcactgccatatcggtatgtgggaggatggtcttggctttgaaggggatgacggcaatgaggataccgatccgtcgacgccgcatctgcgtgggattgacggcgtaaatccatttgaccgcgcgttttccgaggcgctcgattatggcgtaacgacggttgtaaccggaccaggcagcgcaaatcctatcgccggacaaatgtgcgcgcttaaaacgtatgggcgccgtgtcgatgatatgatcgtgcgtgcgccgcttgcaattaaaatggcgcttggagagaacccaaagacaagctaccatgaaaagcagcagggacccgcgacacgcatggggatcgcggcggtgattcgggagcagcttgcaaaggcgcggcgctatgcgcaggaaatggacgaggccgcgcaggatgatgagatagacgaaccggaatttgacgcgaaatgcgaggcgctgctccctttgcttgatgggcggatcaaggcgcatatccacgcgcaccgtgccgacgatatctttaccggcatccgtattgcaaaagagttcggctttggatatgtgattgtgcatggtacagaggcccatttggtcgccgatctgcttgcgggcgaagatgcgtcagtgatcgcgggaccgctgcttggcgcacgcacaaagccagagcttgcaaattcgagcgccgctgggatcgccgcgatttcacgcgcgggcgtgcgggttgccgtcgcgaccgatcatccagagctgccgtgccattgtctgttgttaagcgcccaactggcggctgacagcggattggagcctgcaaaggcgctgcgggcaatcacggccgacgcggcggaaatctgtgcaattggcgaccgcgtcggttcaatcgcgcctgggtatgacgcggacatcgtattgtttgatgaggaacctattaagacacgtaaaaagccgcaggcggtctttatcgacggggagaaggtgcgcggatgagagagcttgcatatgaagcagtggtcgaggctgtgtgcgatctctgcattgaggcaaaccgaatactgccaagcgatcttaagacacgcttgcagcatgcctgtgacgaggaggaatcaccgcttggacgccaggtgctcggtgacttggtgcgcaattatgagatggccgagcagatgtgcctgccaatttgtcaggataccgggatggccgttgtgttcgcggacattggcgaggatgtgcatgtgcaggggttgacagaggccgtcaatgagggcgtgcggcgtggctatttggaaggattgctgcgctgttctattgtcggagatccgctgcgccgcatcaacacaggcgacaatacgcccgcggtgctgcatttacgcattgtgccgggcgaccgcctgtcgctcacagtcgccccaaagggcgccggaagtgaaaatatgagcgccatccgtatgatgacgccggcggccggcgaggaagatctggtacgcgttgtgactgagattgctgtgcaggcgggaagcaacccttgtccgccgcttgtgataggcgttggaatcggaggtaattttgaagggtgcgcattgctggcaaagagggcgctttgccgtgacacatcactgcgcaatcccgatccgctttatgcacagcttgaggcgcggatgctcgaggcggtcaatcgcactggtatcggaccacaggggtttggcggccgtgtgacagctctggcggtcaatattgaaacggggccgacgcatattgcaagtctgccggttgcggtcaatatgggatgccatgtcacgcggcatgcgcagcgtgtattgtaatgctccatgtataagacatggctgatctgtaaatttttaaaagagcattgtaatttcgaccaacgcattgtataatataggcaggaagattagacaaattgttaaaaacagggcagcctgtttttgatataaaacaaaggggttgaatttatgaacattaccatcacagcacgtaagacctcagtccgcgactcttttaaagagcgcatcgacaaaaagcttgcgaagctcgaccggttctttgatgagagtgccaacgcgatcgtcactgtaaccaacgagggggaccgcgagacggttgaggtaacgatccaggcgcagggtatgttctatcgggcggaaaaaacgacgtccgaccgctttgattcgttggaggccgttgttgattctctgttcagacagattgttaaaaataaggacaagctaggcaagcgcctgcgtgaaaccgctttcgatgcggcgaatatggaagctggtgaggagcaggaggaggcatatggcgatttcgatgtcaagcgggtcaaacgctttaccctgcgtcccatggacatcgatgaggcaatcctgcaaatgaatcttgttgagcatgaattttttgtattcctcaatgcagaatcaaatgaaatcaatgtggtttataagcggcgcaacggagcgtatggcctgttggaaccgaaaatcggctgaaaagatattgtataaaaaaggggcgcggatggatcgcgccccttttttatacgttttaagctcctgatttaaggggataaaaaaatgccgcccggactattgcccgaacagcactcctggtggacggtaaggaactcgaatccctgatcccctgcacgtcaaaacagaatctatccccccattatgagcgcaaatgccgatgaatactggagttttttcagctttggagagctctggtacctcaacggttactaacaaaatgtcaattagatgatattaacttcttgttttagatcttcaaaatcagcatggacatatatttcagcggtggttgaatagttagcatgcccaagaatcttttgaagcatttcaggcctgcgcctgacttagccatcatcgacgcaaaagtatgccgtgtacaatgtggattcttcctctcaatacccaaagattccaacagtggataataatctcgggtccgaaaattgttaaggtcgataggggcgccacttctgtttgaaatcaaatatttgcccggagtttcaagccagttttataggccatcggagagaaaattaatgtggcggcggtaacgatgtgggatatcgataccaaccaagaatcccaaagcgtgtaatgcctcggggattacggcaaacccatctttatagaattgagcgatgcggtttactttattgtcaatgcctttgtaatcaggaggacagacaaacgtccaatccgcgccatcatggtcaagcacaagacgaaaatattgatctatatcttgctcgtcaaacccggcctttttaagcaggatgtaatgttccatagcttcgtcaatcggcgcgacgatcgtccttttcccatcgtaggaaacaagcaccagaagcggcccgttttcttctatttcggcattaacagcttgaacggatggatatttaatgacttccatatagataacctcgcataatgattgtttggggaaatttatgatatattctatttagaattcctgtttagtttacataaatctgtttgttgtaaacctcgaaatctaagggctttacgtaaatatttagctcaatggtttgctatttatctaaatttctagggggaattatatttaatttgctaaatttatgaaataaaatacaagacttttcaacatagtttttaattttaaaaatatagaatttagttaagaaaggacggtggttacatggcccgtcaaaagagtgtggaaatgttggatatatattttaaaattgactgtctgaatgaggaaaaatacatgggcagaccaaatcttttacgagtagcaacaaagatcgctaaattcgaaaacccggacatagtgttggaaacgttgcggtcagtccttaaaggtagagtcaataatttgacagacggccagtaaaacctcgccttgtttcttagtgatatcagaaccgtctttgataagtcccgctgaaatcaacatagaatttaatgcgtcaaaaatccttgatatttcatccctcggtacatcctcgattgtaccgggggattttacttttgagggaaggtttacacaatcttggaacagaaaattaggctcaacttgaagtgcatcaataagtgcatacatgataggttctttaggatgactggtttcctttataaaacaagtgtttttgaatttcgatgatgtcaataatatgtaattcaccaatttgttttttcaagttttgtctttttaatttaagtcgcttagaaatgcgaaccgttgtttctttgtgcagaccagcctccttccatttttgtagtacatattcgccaacacgaggcggttgacgggtcatttttaaacagccaacagtgtaattattatgatcaagtataacaacaggtcgaagcttcgatatcgggcaatcatcaaatgggacatctgctaaatatacatcccactctttcataaataaccctcccactcagaatcttcatctggatcataccagtcagcagggagggaatcaacttctggaatcttaacaatatcttttaatctagcgatagggtgcgatttaaaataggattccatatcttggagactgattttcttttcttccccaaaagcagcaatactccatggagtacctaatcggtgtgtcaaatttaataaatattccccggtatattttccgtactcacgcatcacatctaacaaagtctctaattcatcttctgcgaaaattgatcgatcgatatcttgggattcggtagagatcgggtttctcccacagactttatatttatgataaattgcgggaaccaccggaccatacggccaagcttcaaagtcatcatcaaacaaaggttttcctgttctagccagaaagacaccctgcgcaaaataaagcaatttatttagttttagattagtaattggattatcttcacttaaattggtgatattaacgaaaaaatcagcgacatcaaatacatttgccatatagcgcctcctcccttccattttattatagcacaaatgaattataacaatcagtatctaaattattttcaagtattgttttagaggctacttggcctttttataaagaggaattttaacttcaatttgggcatcttccgcccagtctaaaagggtattagtggccgatctggtgatgcggacctcttctttgatgatttcgacatcctctttcaaagcaacaacatcggtgcgaagctcgttttgtccctgcttcaaggtggaaatatcctcctttaagacggaaacatcctctttcaaagcaacaacatcggtacgaagttcgttttgtccttgttccagcttatcaaggcgctcattagtcttgcgctgttcagcctgcatttccataaggatttgcaaaatcttttcttcattgttcatggcgcagcctccttcgggatggtatttctactatatcacgttgatacagggcggtcaacagttcgcaggggcactaaccagtaaagcgcataaaaacgcccctgtgagtgtgtcaaagatcaaaatatgaggagtgcaaaaatgaaaacagtaaaattaaatgaaatcgtaatcaacggcattgcttatgttccgaaagatagcgttacaagtatggcacctgttctggatggaatggagtattacatggtgcggacatattccgcaggcgtattcgctggatacgttgagagcaggaacgggaaagaagctgtattgagaaacgcacggaggatttggcattgggcaggtgctgcaagccgatcgcagcttgccgtagacgggacgagcaaaccagaagcatgtaaattcccttgcccagtcgataaagtcgttttaaccgaagtgattgaaatcatcccgattacgacgaaagcgaaaaacagtattgatgaggtgccgatatgggaagaatgattgacggctacggctaaaaataaaatcgcccccggcgagtggtaacgacactccccgaggactggcaaaccagattgacgtaaccaatcaggtctgttgaggaaattttaccatatcctccggcctgatgcaaggataaggagaaacttattatgtcaaacggcggatacctgggcgaaagcagcaccaaagcggaaatcgagcggcgttttctcaacgcaaagcatgtcatggatgctttgcggcttcggactcagacaagacaatcggtgggccatcaggacttcctggtacaccctgttttgtctcataacaattgtagaaattaggatccatgcgtttacaccccttttctatttgagcttaccacaaaatgcgcggcagcgcaaatagaattacgaaaaaggatgtaatagcaaaccggcaggacgtatcaagtatgcgctatcagcctacaataccaagtcatcgggagtgacactgtactcagaatcggtcatgcagctttattcagaatggaaggggaagcttaatgccagataaacacgtcacagatgcgcccaccatcgtatttgttaataatccagattacaactacatcaaccgtgtactgctggacatttgggcgcgccaaaatggatacaggatagtggaagaacacgacaacagaaacggcatccaatagtttatgcaacagtagggagcgtgaaaacatgaggcgaattaaagtgatctatggagacggaacaaccgagcgatactgcgtaaacgtaagctatgcggaggctttggagttggcgcacgggcaggcgcggaaatagggtatatacgtgcggggattcagttgtgtacgagtatgataaaaagccccgcaggactggcatcccgcgaggcgcataagaaaatgttcctcttaaattgtaacagaaaggacaggggctgtcaatgaaggcatataaagggtttgacaaagatttaaaatgcggagactttcaatacgaggtcgggggcgatacgaagaagccggcgccgaattgtgtaacagaggtttccatgcgtgggaaaacccgttggatatatttaagtattacccgccagctcacggaagatattgtgaagttgaattggatgaggtatcagatgaaacaagcgcgggtgacagcaaacgggttgggagaaagatccatgtcgttcgggaaattggattatcggaaatcattgaagctggcgcggattttatcttcggccatatagattgggacaatagcgcagcgaccaatacaggaacctggagcacagcgaccaatacaggggatcagagcgcagccaaagtaagcggaaaagagtccctcgcgattgtaactggccgcaacagcagggctgttggaagcctgggctgttggctggtgttgaccgagcgggacgataataggcacattcgcagtgtccaagcggcctttgtagatggagaaaaaatcaaaccggataccttttataagattaaaaacagcaaaattatcgaagcgaaggattgatatatcccctgttgtttaaaggaacggaggctcctgacagatcagattgaaaaatattaatgaactattaagagggtttgtcaaatgaaaaaatatgtattctcagaagaaaccatcaacctgtatggaaaaacgctgcacagaatcaaagccacacgggacttttctaatgtgcatgttggtgatttaggaggctttatagaggatgaacgcaatttaagtcatgatgatactgcatgggtcgacggcaaagcgcgggtcggcggcaatgcgtgggtcaaaggcaatgcactgatcaaaggcacgcgggacatattttggatatcccacatcggctcgcgtaacggcacgacaacatttttccgcaacgcagacaacggcatcagcgtatcatgcggatgcttttatggcacaatcgacgaatttgcagccgcggttacaaagacgcatggagacaatgagcacgcgcaggcataccgtcatgcgattgagattgcaaagctgagaatcaaattgggggctgccgaatcatgacgacaagcgaagtatgcacacgttacatagaatcggacaacccatccggagagattatgctgatggcaaggcaaagcggctgcaagccaagcgagattggatatgttttatgaacgattagaactgccatgacttgatgtattccgcggatgctgcacagggagggttaatacttggaaagcaacaaaattatgaaaatggatttcatagatatctttggtatccttgaaaagcacgacgcatggatccggagcaactcgggagggaaaaaggccgatctgtccggggccaatctgtccaaggcattaaatatcgatactctgttgtggggattgaatacagcattttatctcctgcaatgcccgaaaaccggcgcatacacggcctaccaaaaggcaaaaggtgaatttgattgtagagttggaaatcccagccgacgcgctccgcttatcggccacaagccgcacttgcagggccagcaaagcgacggtgatcagtattacggatatagaggggcgccccgctggagactgagcagtgagtaagcaacccccaatttgaatacgttgttgggcaaacaattgaggtttcagattttgatacgaaccgctggtgtgaatgcgcctctggaatccaccactatatcacgagggcggaaaccgtcaagcacaaaaattagacggccagccaggcacaaacgagcgtgcgcagcataggtggtaaaggctctgaaaatagcggaggaataacattaagatgttaccatgctgtccggcgtacccaatatgacagacgaagcgttcagcaatgcagataatgcaagcgcgctcggatataagctttatgcgatggatcaatatgcagcggacttggacaggcaactcaaaaaggggtatttaaggctttgggagatcattacaaaccgcctgaatctgattgataagcgatacaatttccgcgatattcaaatcaccttacagcgcaacattccaacagataaaaataaatcgattgcgcgcggcatatctctgtttaagtccggcgcggtaagccaggaaacagcgatcaacgaaatgcagattgaagttgatgcaaaggatgaaattgagcgtgtgaaggccgaaaaagatgcggaatactccgaggcaatccggcgaggggaacaacaggagatgccaataaacaattcggaaactgatccggaaagcggacgcggcaatgacagatcaaacgtacagtaaacaattttggcgctttgcggacgcccaggaagattcgctcatgcgatatattgaatccctcgatattgcggatcgtacagcgcaggtttttcacagattccggccggatgagcttgacgaattgatgacgccaacagcggtatcacggttgcatcgtgaaacagaaagctggattcagaacggtcttgatgaacgcagttggcgcttgcttgtacgtgatattcaaaatcgcaggcaaatccgcaatcgtgaagctcttgcaatttggttgttggcggcgttcagcgtttattatcaggatatttatttgcggacagggcatatgcgctgtcaatcacaatagaggtatgggcgcgggaatattatgaagcgcagcggatatatcagcaggccgcggacaagctgtcggaaatcaatttcgttgaggtggcgccaacgccgcaaacaaaagacccaattaccaaaaagcaacgctatggcagcacatttgaagctggctggagcgcgattacaaattctttttatgtgaacaggagttgataaaatggcacagaatgatccaagtttgaccccgcctgtagcatcaaagtttacagagctttggtatgcatcaacagaggatacaagtctcaaacaagtattcggcgttcagtccattccaacagttatttcgacatcagaagatattacctatcggacgctggaatctgacactgaattcagcgtaccgggtgtacgcccttatgaaaccatcgaattgagcggaagttgttgcaggcaaaaaggcgaatgatacaattgactttatggagtctgatcttgaaacatgcgggattacaacatttgctgattttgaattctcttttcatattttttcaaccgacgattggcaggagtatttggatacactgatcgttcaggtgaaaaatgcgagtgtagattcatataattatgaatacgatgatacggtactcttctttatgaaggtgaaggaattcgtataatttccaaggaaatggcagaagaaggctctttccttggcccaaatctcagattgtttatagaaaatctaagccaacagggaattactgttcaagtccgtgacgtttcagtgaacggattcatggttgattcatcactttccgcagaggtacttcccaataaacgagcttatacggaattaaccttgatagagtcagatttggaggaaaatggaattacagcagtaaacgaaatcgatttgccttttcacatctttgaatcggaaagggacgggggttttcccgacccttttctctatttattatttatacttggtttgtttggtccgtctcgtcatctttagaaggctggacggcaaaaaacggcgtcaacaattgggcagtcgaaatgccagtagcttgactaaggcgatcaagaattttaaggttagtatgaacttctgcgcgctcgattttcgcatagcttttaacactagtcttgatgcggaatgctaattcctcttgactgatatcattgattgtgcgatattccaaaaggttgcacgccaaaatgaccctagattcatcgtacttcataattatttcctcccgcctcgttatatgacgatttatggaaataattgtataaattagtcgtattttggcacaagaacgataagacccttgacaaacttttttaactgtacagttaaaaacacaaaacagggtggcgtgcgccaccctgtaaatctgatgtcttgtttattattgagcctttttaagctccgtgatctgtgcagtatgagtttttacagtaccttccaaggtactcatacgccctttgaggctgtcgacctccttggtaacagacagcttttcaatcatttcgctgtgctgctcggcgatcaggttgattttgtgatcttgattttcaataagtacgcgggtgtgtcgggcttcttcctcgattttgtctaagcgtgcattgataggttccagcttggcgtccataagctttgcaattgcaagcaaatcgttctgatccagcatccggctcaactccttttctttactatagcatatccataggcgggcatcaaggcttgggttcatcttccggggtgtattccaaaatgtctctgggctgacagttaagtaatttgcaaagttttgcaattgtacgagtgtcaatgccccccttctttaatttttttaaaagtagcttgtccaatgatattatctcgtttcaaagtataagaagtaattccctgattagccatcatttttaaaagtttattgcttatctgaatattgcggcaagcgatgggtctaccggacagattgttttagaccaaggattctaaagacagcgcggaactatccgcacagaatgcgcaaagttcggcggatcaggcagccgaagcaacagagcaggcgcaaaggatcaaatgattttcggatggggcaacggcggatggggaggttttggcggcggcggaatcaacagcccggcgggacagggtgcattgacacgctccgatctctgctctgaatttgcgttcaatgatcttcagaatggcgtctgtggcattcagcagggtatttgtgacagtacatttgccctcaacaacacaatgaccaatggtttccatggcgtagatactgcggtatgcaatctcggctacaatgtgcagaatggctttaaccagattggtcatcagatctctgattgctgctgccagacacagaatgcaatccagaatgttcgctatgatatggcgacacaggcttgcgatacccgcaatctaatccagtcaaccacccgcgggacaggctatagcaacggctgtggctgctgaataatttttccggctttgccgtgataaatcggggcggcaggcaatcgcttgtcgcccctgaattttggagggaaaaagatgtcttgtaaatctgtatgcaaactttgcgaccgccttgtgatatcgcaaagtgtcgcttttactggcggaaacttaattattaatctgcccgcgggaggatatacagacggatgcaaatattgtattgtcgtcgcccaaagtattccagatacagtgacaattaacgcgccggtagtcattacgattggaacgggaacagagcaatatccattaacaaaatgtgattgctctcaggtaactgcctgcggaattcgtacacgaacccgttacgctgtgagggtatctacttccgcaacaagcggaacatttaaaatgcttgggacaccttgctgtgcgccggccaataatctccgcagtattgatggcagttctccgacgccggccccgacatcaagaggaggtgcatcaaaatgaaaccagtgacacgtatgttattgatgcgcggaaataggcgcgaagataatgatagacatgattacgggcgccatatgtatgatgatcgggaaaaggattatgatccttatgacgcgcctcacgatgcatttcgcgaccggcggggccgccgtcattatgataacggcaaatatgcgcctatgcggtcggcttatgatgatatgatgtcatatgattatgatcgccgttatacgcacgatctgccgcaaaaccgccgttatcctatgggatttaccgcgggagatggagcagatcatcatgaatcatatcccctgcctatgcgcggccaatatgaagggcaaggatatattcgacgcagtggagacggatatcaaattggcggcagcgtgcatcaaaaagatgaaaactacgataaaaagtttgaccgcaaaaccgctgaaaaatgggtatctcaaatgagtaagccgggaaaggccggggaaaaaggcggcaagtggacctacgatgaagcaaaatccattctcgaaaaaaagggatggaatgttaatcccgtagaattttttgcggttctcaatatgatttacagcgattacggcaagacattggcaaactacaatattaataataccgatctgtatgctgacttagccaaagattggattatggacgatgatgtagcggcaggagcagaaaagacagcctgttattactatgatatcgtcgaatagaagtaaaagcgcccggattccgggcgctttttatatggatttttgtatcatggaaaactgcgaatttaaggggataaaaaaatgccgcccggactattgcccgaacagcacccctggtggacggtaaggaactcgaatccctgaccccctgcacgtcaagcaggtgctctaccagctgagctaaccgtccatcttttattttgtcaaccgacttgcttattatataataattatttggaaaatgcaaggggaaaattcaaaaaaattaaaaaaatttgtaaatcgtttaaattaactgttaaatggcggagaaggaagggatttgtttgtgcaaatatgtcaaaaattacacggcaatgatcgtcaaaacgcaacgataggcacttgttccaatgtgtaaatatgtgatataataaattgatttggcggtatataggaggacctatgatcatccttggaattgacccgggctatgcgacagttggatatggcgtggtcaattatgaccgcggacgttttgcgccgatccggtttggtgcgatcacaacacccccaaaaaccgatttttcagcgcggctggaaatgatttatgacgatatgacggtgctgcttgataagtcccaaccgcaggcgctttcaattgaacaattgtttttctccaataataagacgaccgccattgatgtcgcgcaggcgcgcggcgttatcctgctttccgcgcgcaagcacggcgtcccggtgtttgagtatacgccgatgcaggtcaagcagtctgtagttggctatgggcttgcagaaaaaaagcaggtgatggagatgacgcggatgctgctaggactggaggcagtgccccgcccggacgatacggccgacgcgctcgcgcttgcaatctgccatggtcacagcgccggttcactgctctcccgcatgaagtaggcggcgcgagcttttgcgctggttttaaatttgtccgcgctgtttgcggattggcccaggaggagtgcggtatgtattattctgtcacgggaacggtgcttcatgcagagccgtatttggctgtgatcggctgctgcggcgtaggatataaatgtatgacgacgctcacaacgctgtcgtgcctgccgccggtcggcggcgaggccacattatatacgcatttgaatgtccgcgaggatgcgctcgatttgtacggcttttacacacaagcggagctgaacgcatttaaaatgctgattggtgtgtcgggcgtcggcccgaaatcggctctggcaattttgtcagatatgacgccggacaagctggcgctctgcatcgccgcaggcgattcaaaaagcctgcgcgcagcgcccggtatcggtccgaaggcagcgcagcgtatcattttggagtgtaaagaccgcattggcgctagtgagttgagcggggaaatgtctgaggtagcttctcagctgcggcatgagacaaccaatatgagcgaagcggcaagtgctctggccgcgcttggttacagccccacggaggctgcgcaggcgttggctggtttagcggctgatatgccggtcgaggatatgatcaagcacggtttgaaggtgctttcaggcggaagataaagcggatgagaatgcggatgaaggggcgtttaatggatgtttgacaatgaaatggattttgaaaaccgaattatggccccggaaagcattgcaggcgacagcgatatcgaggtcacgctgcgccctaagacgctggccgaatatatcgggcaggaaaaagtcaaggaaaatatgcgtatctttatcagcgccgccaaagggcgcggagagccgctcgaccatgtgcttttgtatggcccgcccggcttgggaaagaccacgctttccaatattattgccaacgaaatgggtgtcaatatccgtattacaagcggtccggccatcgaaaaaccgggcgatctggccgctttgctcacaaatcttgcgccaaacgatatactgtttatagacgagattcatcggctgtcgcgcgctgttgaggaagtgctttatcctgcgatggaggattttgcgctcgacattatcattggcaaaggtccatcggcgcgttccatccggattgatctgccgcatttcacgcttgtcggcgcgacaacgcgcgcggggcagctcacctcgccgctgcgcgaccgattcggcgttatacagcggttggagctttatacggctgatgaattgcagacgatcattctgcgcagcgcgggaattcttggcgtgatgtgcgatcccaaaggcgcatatgaattggcgcgccgcagccgcggtacgccgcgcgtcgccaaccggctgcttaagcgcgtgcgtgattttgccgaggtcatgggtaatggccgtattacggaggagatcgctgcaattgcgcttgaccggatggagatcgataagcttggcctggacgcggtcgaccgaaggatgctggaaacgatcatccatggctacggcggcgggcctgtgggactggaaaccttggcggcggctcttggcgaggaggcggtcacgctggaggacgtgtgcgaaccgtttttgatgcagctcggctttttggcgcgtacaccgcgcgggcggtgtgttacggcgcttgcatacagccatttggggataaagacccccggcgcggagcagttgtcgctgggatagacagattcctgtcgattttatccataatctgtttgaaaatcgcttatgatagataggagaatggaaatgggaagaatctttggtaccgacggtgtgcgcggcgttgcgaacggtgatttaaccatacagctggcaactgatatcggccgcgcagctggtatggtagtggaggagacagccggccgaaagccgacctttatcgttggcaaggatacgcgcgtttcgtccgatatgcttgaagcggcgctcgctgcgggcctttgcagcgtgggagcggatgtcgtgctgctcggcgtggtgcctacgccggccgttgcatatcttgtgacgcgctatggcgccgatgcgggcatcatgttgtccgccagtcataatccgtatgaatacaacggtattaaaatattcagtgggcagggctataagctgctcgatgtgcaggaggacgagatcgaacgcatcgtactcgaccacgagcgtccgtatgcggtcaaagccccttctgaaatcggtacgatcagacgatccgatacagcggttgacgattatgtcagctatatcaaaacaacgattgacggcgacctgtcggggatgcgcgtggcgatcgactgtgccaacggcagcgcaagcgtaacggcaaaaaagctgtttgagggtctcggcgcggattgcgacatttttcacgcctcgcccaatggtaaaaatatcaacgatgggtgcggcagcacacatgtcggagagcttgcaaagcatgttgcctgcggcggctacgacgcggggcttgcatttgatggagacgctgatcgatgcctcgctgttgacgaacatggagaacttgtcgacggcgaccgcctaatcgcgttgttcgcataccatttaaaggaacagggaaagctgaaaaacaatacgcttgttgcaactgttatgagcaatcttggtttgttcaaatttgccgagcagcacgacatcgatacgcgtgcgacgcgtgtcggcgatcgctatgttctggaggcaatgctcgcggacgatttttgcatcggcggcgaacagtcggggcatatcattttccgcgattatatgacgaccggcgatggtcagctttcaggcgtacagcttttaagcctgctcaagacgtttcaaaagccgctgtcggaggctgccggcctgatgcgcacctatccgcagacattgctcaatgtccatgccacgcctcagatgaaggcggcgcttgaaagcgacgagcaggtgcgcgcagtcattgaccggctgaatgggacgctcggaggcgagggccgcattcttgtgcgtgcatccggtacggagccgttgatccgcattatggtcgaaggccgagaccttgctgagattgaggcgattgcaaaggaaatcgccgctgtgatcgaggggtaagcatatgcgtgcggcgacgaattggaaggatttcgaggtgctcgatacaagcggcggcgaaaagctggagcgttggggtgatgtcacgcttgtgcgtcccgacccgcaggtgatttggaatacgccgcgttccgacgcatggcggcgcgccaacgcgcgctatgaccgctcgccgtcgggcggcggaagctggcgtgtgaagcatctgccgaaggcggaatgggaaattggatatggcgatctgcgctttcatatccgtccgacaggctttaagcataccggactgtttccggagcaggccgtcaactgggatttgatgtccgggatgatccatgcggcgggccgccaactcaatattttaaatctgtttgcctataccggcggcgcaacgcttgcctgcgccgccgccggcgctcgtgtctgccacgttgacgcgagcaagggaatggtgcagtgggcgcgcgacaacgccgctctttcggggctgtcggacaggcctgtgaggtggatcgtcgacgactgcaaaaaatttgtggagcgtgagatcaggcgcggcgttcgttatgacggcgtcgttatggacccgccgagctatgggcgcggaccgggcggcgagatttggaagctggaggactgcatatatgatctggtgtcgctgtgcgccggcgtgctttcggacgagccggtatttttcctgcttaattcgtatacaaccgggctgtcgccgtcggtaatggcgtacattctatcggtaacggtcggcacacggtacaggggaaccgtcgcagccgacgaaatcggtctgccggtcagcagcaccgggctggcgctcccgtgtggaagcacagcggtctggacccggtaatgtgtttttaagcaaattaaacggccggtatcgctgcggcgaaccggaccataaataaggagacatccaaatgggagacatcatatctgcacagaaggtagtttttggctacccgaaggaagacaatgaactgaatatcgtcctgcgcggcgtgagcctcaccattcccgaggggcagcttgtggcggtgcttggccacaatggttccggaaaatcaacgcttgcaaagcattttaacgcgatcctcgtgccgaacgaaggtgttgtcgaggtgtgcggcatcgatacaaaagatgaggacaggctgtatgacattcgacaaacggtgggcatggtgtttcaaaatccggacaatcagatcgttgcaaccattgtcgaggaggatgttgcgttcgggccggaaaacatgggtgtggagccgaaggaaatccgtctgcgcgtcgatggggcgctcgccgatgtcggtatgtccgaatataagacgcacgcgccgcatcagctttcgggcgggcagaagcagcgcgtcgccatcgcgggcatcatcgcgatgcgtccgcgctgtattgtgcttgacgaaccgactgcaatgctcgacccaaaggggcgccgcgaggtcatctccacaattaagcgcctcaaccgtgagagcggtgtgacggttgtattgatcacacattatatggaggaggcggcccaatgcgaccgcgtcgtcgttatgaacgacgggcaggtccttttggacgatgcgccgcgcgctgtgttttccaatgtgcagacgctcaaggaggttggtcttgacgttccgcaggcgacagagctttgctggcggctgcgccagaagggagttgaccttccaggcgatattctgaccgaggacgaggctgccgcggcgattgccgaggcgctcagaaaggcgggctgcgcatgaatgcgattgaaacgcgggaattgacctatgtatattccaaaaatacgccgtttgaaaaaacagcggtcgatcatgtcaatctggccattgaagcgggcgaatttgtaggtgtgatcgggcatacaggttcaggaaaaagtacgctgattcagcatttcaacggcttgctcaagccgacctcaggacagattttgatcaacgggacggacctgtggggagaaaaaacgaatatacgggaataccgcttcaaggttggtctggtgtttcagtatcctgaataccagctctttgaggaaaccgtttacaaggatattgcgtttgggccgaccaatatgggattgtctcccgcgcaggtagacgagcgtgtgcgcgaggcggccgactttgtcgggctgcgcgctgcgttgctggacaagtctccgtttgaactgtccggcggccagaagcgccgcgtcgcgatcgccggcgtgcttgcgatgaacccggacattcttgtgcttgacgagccgaccgcaggacttgatccgaagggtcgcgaccgcatcctcggccagattaggcagtaccataaacagcgcggcggcacggttctgcttgtgtcgcacagcatggaggacgtcgcgcgctatgcacacaaggtgcttgtgctcaaccgcgcgggcgtcgccatgtatgacgatgttgcgaaggtcttttcgcgcgccgatgagatcacggcgatggggctttccgtgccgcaggtgacgaggatctttatgggcctgcgcgcgcagggctttccggtcagcgaaagcgtttatacgatggactatgcatgccgtgagctgctcgatcttcttggaaagggaggagagcagaatgcttaaagatatcaccattggtcaatactttcccggagcgtccgtcctgcacaagctcgatccgcgtgtcaaaatcgtgctgaccatcgcctatatcgtcatgttgttcgctgcctcaaacgcagttgggcttgctgtcggcgtcctgtttttgattgttgtttacgcggtgtcgaaaattccgccctccatgattttaaagagcctcaagccggttgtgcctatcattatttttacgtctttgctcaacatgctctttatcgacggccgggtgctcgtctccttctggattttgaaaattacggctgagggcatccagacggctgtttttatgagcgttcgcatcatctgcctgatcgcgggaacgtcgctgctgacctacacgacgtcgccgattgcgctgaccgacggcatcgagcgcctctgcaatccgctcaagcgcctgaagatgcctgtgcatgagctggcaatgatgatgacaatcgcgctgaggtttatcccgacgctgatcgaggaaacggataagatcatgtcggcgcagaaggcgcgcggcgccgatttggagagcggcgggcttatgcagcgcgcacgcgcgctgattccgattttaatcccgctgtttgtttcggcgtttcgccgtgcggacgagctggcacttgcaatggagtgccgctgctatcgcggaggtgaggggcgcacacgcatgaagcagcttaaaatccatgggcgggatatctggtgttcagcggttgttgtcgcctgttttgcatgtgtgatcgcagcgaattttacgccgtggcaaatgctgctgtccacggccggtctgtgagcggggggatcggatgcgccatctgctgttaacgattcgatatcgcggcacacgctatcacggctatcaggtgcagcagaacgctgtgacggtggcgcagacggtgcaggacgctgtcgagcgtatattcggtgagcgtctgccaatcaagggctgttcgcgcactgatgcaggcgtgcatgcaaactgcttcgccctgacgctgcgcacagcttctgtaatggcatgcgatgcggttgtacgtgcaatgaacgtccatcttcccagcgacatcgccgtgacaggctgccgcgaggtgccggaagcatttcatccccgctatgactgtaagggcaaacgctacctgtaccgcatctataacggcacggtccgggacccgttttcggccgatttggcgcttttttggaaatatccgcttgacgaacgtcgaatggatgcggctgcgcaaggttttgtcggtacgcatgattttgccgcgttttgcagcagcggttcgggcgtacaggacactgtgcgcaccgtgacggacgcgtcggtgacgcgtcacggggactttgtgatatactctgtcacaggaaacggtttcttgtataatatggtccgcattatggtgggaacgcttttggaagcggcgcgcggcgtctatacgccggcagacgtgctgcatatgcttgaggggcgtgacaggtccgctgccggaccgacggcgccgccgcacggtttatatttggacgccgttttttatgacgattgattttgatggaaaggagatacccagttggcgcagttaaccgatcttgaaaaagtacgccgcagccgtgcacggcgtaaattggtgcataatcttgcgactttgctcttatttgcggcaatcgttgtcgttgtgacggcgctggtgcgccatgcgggtgattttgacctcaagacggcatacagcgatatcaccgccgaggtacgcggcggcgatgggttccccgttgcgctccccggcgggaatgtggtcgctttgcaggcggccaatgaaaccctggtgcttttgacagatacaaacctgtatacctacaaccgttcaggcggccaaatgctggacgcgcagcatggtatggctaatcaagcaatgaaaacagctaaggagcgcattttgctttatgaccgcggcggtacacgcgtagagctgtattcacgcgcagcgcaggtttgcacgttatcgactgactttaccatacataccgctgatgtcgcgccgaacggaaatttcgcggttgtaaccggtgcgagcgatgctctagcacgtgtcgttgtatacaataagcgtggcagtgaaattttccggttttcatcagataagcccattatcagtctggatctggctgattcacgcgatttgatgtacatcggttttactgatacgtcaaatggggaatttttgtcaagcattcgaaaatttcagctcagctataatgaaggcgatctcgggcgcaaggactttcccggagagctgctgctctcagtcgaaagtctgagtgcaaacagtgtgcgcgcctttacagaccagcgtgtcgttcttttggacggcgatatgcgtgagacggcttcctatatttttggagacggacagttggagcgttactgtgttgcgccggacggacggcttgtgcttgtgatgggaaattatgaaaaggataaacgcttgtcaattgttacgcttgaccgtgatctgacacaaatcaaccggtttgaaacagatatcaatgtaatggatatctgtgcggacaacaactatctttatctgatggcgcgcgaccatctgcatgttctgggatttgacggttctgccatcgtttccacacagataggcaaactgcaaagtatagagaccatcggatcaagtctttactatgcggctggagctgaactggattcgatcgatgcgaagcagcttggccgcctggaggaaaataaatctgcggcctccgattcatcctcattctcccaagcgtccgtgtctgctgatgaaacatcctcaagtgcacaatccaatacgtcaggggacacgtcagaaggctctgatgcagccgtatcggagtctttggaaacagttttatcatcggctgctgccgcttcaacagaaatggacgcatccagtcaggcaggaacataattttatttgtaaatgatcagcatatttggtataataaccgcaaagcggatattataccggggttatgcccaaaggctcgccgcttacgcggcaaccgccttttgatgggcaattataccatgccgcttcgcggacatggtataataaccgcagaacggttattataccatcttatggccagggcgatacgcgggcgcggcccgcttccgccatgatgtccgattataccatgccgcttcgcggacatggtataataaccgcagagcggttattataccgtcatatggccagggcgatacgcgggcgcggcccgcttccgccctgatggccgattataccacgccgcttcgcggacatggtataatataaaatcgtcatgcaatgcagatttgcaggacatgaaaggattgtatatggattctttgacagccatcgggcttgatgtcgccgctgtagcggttgtggtatactgtgcatacgcggcagccaagaagggctttttacgtacggtggtgcagatgatcgcttatgtggcggtattggctgccgctctgtttttcagccgttcggccgcgccggtcgtttacgatcgtgtcgttgagccgattctgatgcgtcaggagctgcatgagcctacaggggatgccgtgcttgtatctgcgtcatccaatgaggaaccggcctcgcttgatgggattatcggtgatacgatcgatgaatttttgggcggtgaatctgccggagatgtgaccgacggactgattggagatctggcggacgcaacgctgcgccccatgatgatcagcacgatttcggcaattggttttgttttgctgtttgctgtgctgtcgcttgccgccaatatcctgttgtcggcgctcggtatcattaaccatttgccagtgatcggcacactcaatgcggcgcttggctgtgtggttggaatcctgcaagggctgctgatcgtttggattcttggcgtattaatcagcggcgtgctgaatctgaattctgacggttggtggatttttacgcaggaggcggtaggacgcacacatatatttcactactttttgacgccggagctgcttgcacggttccaatagatctcaacggtttgaccaacaaatcggtatgaaaagcggagcaatgggaaaagcagcggcacggccggcaattaaaaatagcctaggaatgcattgggagaggaaattgggaaatccgctggtgcggcggtgtttccggcgggatgcttaaaaaaatcggcgtccctgcgagggggagtctgaatgaaactgaatgtgccgaacgcgttgactttgtttcgaattctgctgattccggtatacttatggcgatatctgaccgcacaaagtcagatggattatttaacagcggcgggaattttactgctttcggcgctcagcgatacgatggatggatatatcgcaaggcgctttcatcaaattacccagcttggaaaaattcttgatccggcggcggacaagcttacgctggctgcagtaattgtttcgctgtggctgacacggccaaattggtggccgttgtacacgctgtttattctcaaggagtttttgatgctgctgggcggcctgcgcctgcatcgcaagcaggtcaaaattgaaggggcaaaatggttcggaaagctctcgacaatcatgttttatgtgattatgattatcattgtggcgatgccgcagcttcaggatcgcacaatcttgaccatgctgttggtgttgcttgtgttcatgcttttttcacttttgagatacggaatgctgttttgccatatgttgaaaaattcaacaaaaaaatgataccgtattagtagattatttatctggtattaatatgctgttcacaacgggcatatacaatataacctgaataattattttaacagcgcggatggataggggagcctggttcatcctgcgcgggcatttgcccgcgcaaccgctgcccgcgcgcttttcgctgtccaaagcgccggggttcccggtctggccggcggggcagtggcggaaaggagcaaaaactgatggatatgatgtgttcaagatgcaagaaacgtcttgccgttgtttttatgacgcggcttgaaggagataaaacaatttatgaagggctgtgtctgcggtgcgccaaggaattggggcttaaaccggtcagcgacctgatggagaaaatgggaatcacagacgacgagctggacaatatgtccgatcagatgatggatatgttcggcggcgaaggtgaaaatggatttgaaatgggcggtgcgcaggcgcttccgtttttgcagaatatcctcggcgcagtcggaaacggtgagattattccgcaaaagccgaaggaagaaaaggattcgccaaaggaacctacagtcaggccggctgagaggccgaaacaaaaggaacgcggccgccggggggcgccggagaaaaagtataagcatctcgacgcctactgcgacaatctttcactcaaggcggagcagggcaagatcgaccggattatcggccgtgagcgcgaaatttatcgtgtgattcagattttgaaccggcgaacaaagaacaatccctgcctgattggcgagccgggcgtcggaaagacagccgttgcagaggggattgcgcagaagctcgcaagcggcgatgtgccataccgtctcgcggacaaaaagctgtatttgcttgacctgacggctctgatcgccggcacacagtttcgcggacaatttgaaagccgggtcaaggggcttgttgaggatatcaaggacgcgggaaatgtcatcctgttcatcgacgaggttcacaatctcgtcggcgcgggtgattcagaaggttctatgaatgccgccaatatccttaaacctgcgctgtcacgcggtgagatccaggtgatcggcgcgacaaccttcaacgaataccgcaaacatattgagaaagacgcagcgctcgagcgccgtttccagccggtcacggttgaagaaccgtcgatcgaggacacggtcgatattatcaagggtgtacgcagctattatgaaaatcaccaccgcgtcaaggtcagcgatgatctgtcgcggatggcggttgtgctgtcggagcgatacattacggatcgttttcttccggacaaggcgatcgacttgctggatgaagcgtgttcagcagccgtcctgcgcaatacgcagttggctgaatacgataaattgacaaagcagctcgcagatacaaacgaacaattggaggagttggaagccgccacagacgagccggattatgagtcgattgcccgcctgcgcggtgaaacaattgttctgaatgaaaaaatcaatgagcttgcgccgacggcggttgaccagccggttacgcttgacgatcttgcaggtgtgattgagctttggacagggattcccgcggcgaaaatccgtgaaacagagctgcgccgtgtggcaaagctggagcctgcgcttcttgaacgtatcattggacaggatgaggctgtttcgcttgttgcggccgccgtgcgccgttcccgtgtgcaaatttccgcgcgccgcagacccgcctcgttcatctttgtcggaccgaccggcgttggaaaaacagaactggtcaaggttctttcaaaggaattgtttgattcggccgatccgctgatccgtctcgatatgtctgagtttatggaaaagcatacagtcagccggctggttggctctccgccgggatatgtcggttatgacgaggcgggacagttgacagaaaaggtccgccgcaagccatattcggtcgtcctgttcgacgagattgagaaggcgcatccggatgttctcaatatcctgcttcaaatcctggatgaaggccgtatcactgacgcgcatggccgagtctgctcatttgagaacacagtgattgtgatgacctcgaacgccggcagcgagcgcaaggaaagtgcgctcggtttcaaccgtactactggcgaaatcgccaaggataaggcgatgaaggcgctttcagagtttttgaggcctgaatttttggcgcgtgtcgacgaggttgttgtattccggccgctcggtgaagcggattaccgcaaaatcgcggctttgatgctgggcgaattgaaggcgcctctcgcggagaagggaattaccttcggctgggacgatgaggctgcggcatatattgccagcaaagcggtcggcggcaagagcggcgcgcgcgacctgcgcaccattatccgcaaggaggtcgaggatgcgatcagtttgcggctggtggaggatccggataatatcccggctctgatgaaggttacaactgaagatggaaagctgaaaatgctttacagttaagtcaaagaagcaaaaaaggcagggcgttcgtatcgcgaacgccctgcctttttctttttatttgcttagatgccgttgttgacagcggtccagggattgacaaacacattattaaccgacagggcaaagtgcagatgcggtcctgtcgaatatccggtcgaaccgacagcgccgatctgatcgccttttttaaccatatcgcctgtcttgacattgagggaatccatatggtagtaccagctttttaacccgaatccatgttcaatgatgactgtattgccggtcagttggagatagtcggcgaacaaaacgcgcccgttgttggccgccgagacgatgctgccgcgcgccgcagcgatatcggtgccgttgtgccgcgtgggcgtcgggtcgtcgtttgtataacggatgcttccaaactgtgttgagatgggtccaaaggctggctgctggaatgggttttcccaatattgctcctcatcgcaaatcagtttaagaggctcgatcttttcattccactccgcattggcctgagcactcagcgctgtttcagcggcagtggattgaggcatggtcatatactgcacatcaaaatcctgctcctgcaccgtgagagagtgtgtcaatgtctgcccgccggcctgaactgtaacagtataaactccgggagaagccgtataacggattggaagcagggcgatcttttccgctccataggaggatgacgcgctcgtaaaaaatcgcggagcgaatccaagatcggtttgcgctgtcagctctgttccctcggcgtgagctacactgatacggagcgtctctccctgtttgatggccgaggccgccgtcaatgttgcaggaaaatcacaatccatatcaaacaggtatgtatctccgctggaagctgtcacaatgtatctgaactgcccatcgcaagcagggatgaatttttcatcagcatttccttcaaagatggattcggcctcataaaaaacgctgtatgttgtccctgccggggctgcggaaagatcgggaagctggtcgtgcgatttgactgtaaacagcggtacgctgccgatttctacttgggtagtctgttccccaagcgatacagaaagcggctgcgccgcacgggatgatacagaagcggtgcgagaggaactgtcatccgaaacggttgaagcggtttgctttggcgaaagcaggcgcgcgccgcatgctgaaagtgtaaatgcagcgcagagcgtcaatgcggacaaacggatgggaaggtttttcattgtgtgatgcctcctttttgatcatgcagtgcttggcaacaaaacggggtgcaaaaccggccaaagccaaacgcacctgggttatttgctgtattcattttaccgtgacagtgccaaaaggtcaatggcgctttttgtcgcgctttcctttcgcaattaatattacaatcttcatctcagtaaaaatgttgcattttctcttgcaatttccctctttctgtggtaatatattacggctggtaaaatgccggcagaacacacaccaggtgatcatctgatcggtgtcccgcattgggatgatgggatgagatgaacctggtggcggaaaataaccgaaagagaggaatttatcatgggcgttgtatcgatgaagcaattgttggaggcgggtgttcatttcggccatcagacaaggcgttggaacccgaaaatggcgcgttatatttttacagagcgcaacggcatctatattattgacctccagaaaactgtaaaaaagctggacgaggcgtatatgtttgtgcgtgatctggctgcaaacggcggcaatcttctgtttgtcggcacaaagaagcaggctggagattccgtcagggatgaagcgacccgcgccggtgcatactatgttaacgcaaggtggctcggcggtatgctgaccaacttcaagacgatccgccgtcgtatcgaccgtcttgcgcagctgcgcaagatgcaggaggatggcacgtttgatctgcttcccaagaaggaagtcagcaagctgaaccttgagattgaaaagcttgaaaagttcctcggcggtattaaggatatgaaaaagctgccgtctgcgctgtttgtagtcgatccgcgtaaggagaagatcgctgtcgcggaagcgcgcaagctcggtatcccgatcgttgcgattgtcgataccaactgcgatccggacgaaatcgattatgtgattccgggcaacgacgacgcgattcgtgcggttcgtctgctgtccgctacgatggccgacgcgctgatcgaaggccgtcagggcagcgccgaagcggcgcctgaggaagccgcggagaaggaaaacgaagcggacgcgtccgccgcgaagtaaaaacacaaacgtttacgatagacggaggttaacagcatggcattcactgcgaaagatgtacaggcgctcagagagcgtactaactgcggtatgatggactgtaaaaaggccctgaccgaagcggacggggacatggataaggcgattgaaattctgcgtgaaaaaggtctggccgccgctaccaaaaaggccggccgtatcgctgccgagggcgttgtccttgcgacagtcgatccggataccaaggtcggcgttgtgatcgaggtcaactctgagacagattttgtcgccaagaatgagaaatttattgattttgtcaagtcctgcgccaagacggttgcagccaataagccggcggacattgacgcgctgatgaagctgccagcggtcggtatgaatatgaccgttgaggaggaactgcgcgacaagattttgacaatcggcgagaatatgaagatccgccgctttaccttcgcggaaggcccgcttgtcacatatgtgcatggcggcggccgtatcggcgttatggtgactttcgatacggatgtcgctgataaagacggttttgaggcttatgcgaaggatgtcgcgatgcaggtcgcggccattaatccggcgtatctcaatgcggaatctgttccggctgagattatcgataaggaaaaggagatccttgcggcgcagatcgccaacgatcctaagagcaaaaataagcctgagcagatcatcgccaagatggttgagggtaggatcggcaaatattacaaagaaaactgcttgctcgatcaggcgttcgttaaggacggcgatattaccgtcggccagtatactgagaatacagccaaggcgcttggcggcatgatcaaggtgacgggattcgttcgttatgagaagggcgagggactcgaaaagcgcgaggacaattttgctgaggaagtcgccagcatgatgaaatcataaaaaatttattcccatccggcacaaaaccgccccaaaatccgttattttgacgggttagaatgggaataaaactgcataaacatgcgtagaagcgcaggatacgtttgtatcttgcgcttttttgccggcttaaaaggggattcaaccaaaagttcctgcactgaggaacacctgccgctgttcctcctccgaaagcgatgtaagcgcactggcggtatcccgcgccgtcacttggacagccagtgctgaacagccctgttggaagacggcatagaacgtggctttccgccgaatcgttcctgttttttgagaaatatcgaaagaaggaagtaaagagccgccggctctttacttaaaatagtcagaactgaaagggcgaagctagattttgcagcagcgatactacgctccaggctgcaagcgtactgctgcggggattggaaggatcaggcaaagaggaagtctccagcgttacccgtacagatttgttctgcccgtagatacagtggctgttttcctccaggccaggaacgctgacgatttccactgtcgtgttttctggtccaacgccagatagggcggctgctacagcaacattgacattcttaggaaaactccgaattgcttccagcgcagaaccggaaaagaccagttcttcccgctcgatggaaagttgttttccggcaagaccgggagcgccttcaagactgtggggagcctttctgttttcaacacggatcttcatgtctttgtccatcaggcgcatggcccgcagtacatccaatccgccgatagcgccggaaggcaaataaattttacagtcgcatttttccgctgcctgtcccaaggagtgacgaaatgtttcgtcagccagcgccccaacagacagcagtatgagattactccctgctgtcagtatcctggcgccatattgacgtaccgcatcccctccggccgcttccaccacatagtccggtgtatctgcaagcagcgattccaaactgccgtaagctttacatcccaattcttcagccagcttaatgggctcttggggagtggcgcccaatatacccaataaaatatattgctcctggagcatacccgtcaaggattgagcgatgatgctgcccagtgcgccgcatccaataacagataccctttttttcatctctttatcctccttggagagattattttggattgtaaagttaaatgaaaattgaggatcagttagcctctttttatatattgcttttaccataaatccaagtagctcccgaaaggaggcgcgctttcatggcaaaattaccaaacgcgcccgcttattttttaccccgcacttcgtcaatgtagctgtatacagtcacccgggagatccccattcgactgcctacctgatccaccgcgcctttcagcaggaaaataccccgttgatccataaaacggatcagttccagtttttcttcccggcgcagccttgccatatctttatttccaatgattttgtcaatcaggtcggtgacgatctcgctgacatgggttaattcttcctgagaaacttccgccggagcagcgttttcttctgttccgggcatcaggctttgaagccattcaatttgttgggagattttagtggtatcgatgttaatacacaatgcccccacaactttgcctccaaaatctttgagcagggcagtggaggatttgatgagtctgccgtctgctgtgtggaaataatagtttgtcactatgtcgtgatcgagctttttggaaaggatcacctgagggaccagatggtcaaagctttgtcctacttgccggccggtaacacggttgttgacaatatagactacggattgctgagggttttccaggtcatgaaggactacttcgcaatcgtcgccaatggtttgagcaatcatatgtgcaagaggaatatattgggccaaaattggtttgatcatgaatttagcgcgctgtccggggcgggaagcaacgctttcctcctctctttgtccgcttggtaaaaattgatgtattatttatcataacacttttgaaaaaatggtgcaacaaattctctgcctgtaagaagcgagcatgattgcagaaaaaacaaatgcaatggaaaacaggtccactcataaggcgggcctgtttttcaggattataatgttcagtctttataagtgatattttgttcaagagacatcagcagttgaatatatgcgtcttttgtcatttctggtttgaagttttctttgacctgcgcggcgccggaagcgccatccgccagcagatcaatcacggtgcatgccagcattttgaccggtgtgataaaagcgtcgtccaggtcgataatgcggtaatccttagaatgaagacctccttccacgccggaagtgatgcaatggagtaccggcataaacagggacagatcgccgatgtcaaaggaagcggtgctttccatgcaggggaggatcttgtcctccggatagaagcgaacggcattatctttaaaaatagccgccatggttttatcggctgccagcggcatttgcccggggctatcctcgactgaagcggtcccgcccatagcgatggccgcaccgcggatacagcggttcactttatcgttagcatcccgcagggcagtcagatttcttgcacggacagtagtttccaactccacatcatccggcacggaattaacgatatcgccgcctcggttgataatctgatggatacgcacgcaatccttgtccttgaaagtttcacgctgaacatgcatactgttgattgcaatgacagccatgtttagtgcgtttacgccattccagggcgcggcgcccgcatgagactgtttgcccagaaaatgggtctttttgccgatgaagccgttgccggtattcatgggggcgcacttataaccgtccgcttcgatggggaaattgtgagccatcatgcacatatccacatcgtcatacgctccacgataagcaagctccgctttgcctgcataaaagcgaatctttccttcatcgcgcaggcttttgcgatagtccagctcaatatattcttctgcgggcacggccataaagtccacactgccgtccagttgatccatcacgccggaatggatcaatgcggctgccacaccatacataacagaaacctgaatgttatgaccgcaggcatgtatggcgccggtcgtgggatcacagtcaggatgactgcggcagaccacagaatccagttcccccataacggcgattttcggtccccgtctgcctttgtttgcatagccgcggcagccggtataagcaatgcctctatccacgggcaaacccagctcctccaacgctttggcaagggtctcggttgtgcggacttcacgataaccggtttcagggtgctgataaatttccttacccaaggccaggatggcgtctcggtcccgatctacctgttggatcaccagttgcttcatttgttccttgtccataggatgcagcctccttttgatttttaggcttataaagttcagatcatgccctggagactcaggattgcctgggagatgagggcggagccaaagaatgtgccgcagaacaccacaatggcgaccagaatcatcttccaacttaaacgtttgatgtcattcaatttggttccaatagagataccggccacagccaaaatcaccgtaccgatttgtccggatgatatctgtgcggtcatatcgagcagaatgtcgtcaacaggcgaccagggggtggtcaacagcagagccaacagggaagcccatgcgaaagcgggaatcttccaggggataagctccttgatcttgagcgccagtacacagatgacgatgatgcacagcataccaatacaggctttgcctgcctcaaaggaaacgccgcccttgatcagattgacccactgggtcatcagaataacgacgccgcaaagcaccagtgctttgcattggttaagagtctttgtcatagcgatatcctcctctgttacggcctgcaatctcaggcgttggcttggttcttatgcatgaccgcggacaattttttatatatgaagttggctacgggcagggcgatgaacagttccatataaagtccgtccacattggtacaaatgtttgaagttgccgcaaaggccaatatttcttcagacatttgagggacgctggctgccagagcctgggaagctgccgtcatcatagagccggaacccataccacaggccatagctagtgcatacggatgaataccggtcaatacaccgaaggaccccagcagaccaaagaaaatcgtaccgaacagatttcctaccatataagtacccatgacgccgatgccttcgggagaatcgatgccatagatttcagaaacaagtcccaaagtaggctcgcggcaaatggaaagcgttgcgcctaccgcttcacggcgcattcccagcagcattgcgacgggcagaccaacgaccatggtgcccaggttgccgaactcctgcaggatcagagcaggtcctgcctctatgacctttgtaatgttgggaccggcagccatgcccaacttgacgcccaggatcaacaggaccagcatcataatattctcagacagcttaacttccttttcgctgcatatttttttcagcgcctcaatttttcttcccagagcatcgggggtgataagcactgccagaatcattgcgaagatcataggcagaatgatcagactgcccggtcccacaggaactttgaaggtgccaatgatctccccgagagcggatgtaacgccgcaaaccgcgaacaatttgataaatacaggccaacgccctttcgtgctcagactgtcctgctgcgtgttgtcgggcttgtttttttccacctggtttgacatgaatactctcctcctatcaaaaaatcaatgcattcctctcacagtctgctcaccggttttcaatcagtgtgtatacatccttgcggcgatgggcaagcagtggcagctcgcggcgtacctgagctacccggtccagttccagagtacacacgagcatttcctgatctgctccgagccggcccaatacatccccccaaggggaaactgcgatggaattgccataggaagtgtagccggaggaagggtctctggctggcgcggctcccaaagtaaagacctgattatccagcgcccgggtacggaacaaaatttcccaatgagcgggaccggtcgtcatgttgaaagcagcaggcaccaggattaccttcgctccccgctctgccatcagccggcttaattcgggaaaacggaaatcgtaacagatgcacagccccattacaccaaattcagtgtcgaaagtggtgatactgttgcccgcggtaagtgtgtcggattcccggaaggacattcctccagatacgtcaatatcgaatagatgcatctttctgtgtttggcgatctgctgtccctgacggtcaaaaacataggcggtgttgtaaatttttccatcgtcgtcccgttccggtatggaaccggcagccaggatcaggttttgttctctggccattcgggaaagttccagccagatttcctctccttccctttgtgcatacagggggaaatttttgttctgataagggcagcagaacatttccggcagcaaaaccaaatctgcacctgctgtagcagcttttttgataaaagactccgccaaggataggctgtcgcagattttgggctgtacttgcatttgtaccagagctgcttttaaagatacagacattgtttctcctccttattgtaaacggccgcggcagagaatcggaatttcctccacaacatcgccattggaaaccagcgccgctttctcataaagattgcaaacagggcagatatggactggatagaactccaccttgtctcctacgcggactccatcacggaaagatttatcatagatgatggcgtgttcgtcatatacatcaaaaatatgtacgttttcaaaccccttgactgttcccagtccgggagtagcgcaaatacctttttgacgagtctgagcggtaaggcctttggctcctacatcagtaataactctttcagcagtgggccggctgataacggtggtcagaaccgtagcagcgcagcggtccagggtaccgatggcatgtccctgactggcatccatcagcacataggtgccaggacggatttctgtaataccgggtagaatatcaaatccatgcatcagggagggagtggaaccgatacttacaacttgaggaaccatacccaactcccgtgcgaggcgcgcaaaggaaagggtacgctcttggctgatgatgaatttttcgcggcaatcctccactgtttcggcgttgtagcaatggccttcatgagagaaaatacctgcaaattctacatgcgcgcatctgcggatagtctcaagcaatgcagtaaaatccgcttcatgaataatcccggaacgattttcgcctacttcaatctcaatcagcaaccgtgcggggttctcctcttgggcgaatacttcttctgcggcctccacctgacagggggtatctactgcgaaggaaatggttataccgctgcggccaagggcacggatacgttccagtttctgctttccgacaatttcattggcaataaaaatatcctgcaaaccattttgagccatgacttcagcttcgcctactttggctacagtgatgcccttggcgcctagctgttcctgcagcttggcgatagccggcatcttatgggtcttggtgtgaggacgaagcgcaactccctggcggtcggcataatcctgcataaaatgcagattatctatcatcttttcgcggtcgatgatgagcgccggcgtatcaagctctttataattcatccctgaagcctcctgatataaaagttcggacagtacgtttttggatgatttagggtcttaactgttcatgtttactttacattcccgcttcagttgaacgactgcttccacttccaccaggcagcctccatacaggttattggtgggaaccaccactctggcaggtttgtgatcgccgaagaagcaggcatattcttcgttcaagtcgggccaataagccacatccggcaggtagacccgacacatgacaacatcgcttcgttctgctcccgcagcggataaaactgtatccagatttcgcaaagcctgggcggcttgagcgtggaaaccctccggcgcttttccggtttccgggtcgatggaaagctgtccggaaacatataaagtcccattgcagatcataccggggctgtaatggcctccatcccgtacagaatactgggtttcgatcttcttcataccaggcaacaactccttttagtgggattttatccttctttgcagtgtccggcagagcgtcggactgaggaattaccctcatgatatataaaaaaatatacaaagtcaatacttttttctataatcatataattttatctacataaacagaaaaatacaagtagatttgtgctaatttatcaaaataaattttaaaattaaattatttttatcgacttaggatgatgtaacagcaatttggggggtaaaaaattatacaatatcgtatggctgccataaatcaaagggcagatttatggcagcagaggagtgttgctgtccggtaatattgcggcctttttgaaagtaatggcgtaaaaaaatggcctgcggcatttcaaatgccgatatctgtgagataccgggcctgaaaagctgcgaggccatttatttagaaatataagccaatggcatcaactgtcccaaaaggaacggctacaaacattcgtacacatctttccgtgcagaaagcaggctgctgctgagaaaatactgaaattttaacgatcagacagcgtgggtttttttaagacagcaccagccagcaggccgacaacaatggtagtgatgatcatttccggaaccatgtaagaaccattgtacagcagggaatagagccaaacaggggtgccttcgggagcataaacgccccatatcagaatgccgcttgcaatatgacagagataacgtaccgctgtaacagccagagtaccgacgacagcgcctttgaccggctttaaaaagggtttggcaatgatgcctgcaagccccagcacagtatacgcgattacataatcgagcaggatcaccagaacgtaccagaggacagtctccacaggaggcgcgctgataccatccaagagcatctgaagcaggctgaaagtaaacccggtcaaagcgccccatccgggtccgaacatcagtccggccaggacaataggcgccattgcggcggcggtgatggaaccgccattgggccagggagcaaacttgacaaaattcagcgccactgccagcgcagccagtaaagcgcacttgaccaggacaaaagtttttccgttgtgattcatttcaaattcttcctttcttcttttcctgttgtggatgccatgaaaaaaggacgttggcaatgcgccaaacgtccctggaagatcacaataatgtcactccctacgctggcataatccagatcaggtcggagggtcatgaggtgaagcctcaaatctcagcccgcaatacgggcccccctgttgattgtttcatcagtataatcgcatttttataaaatgtcaacaaaaaccggcataaagttccagatagatgcaaaatcaattgaaagatccaaggaaacataaatatgaataaaaagacaaagtaccgcccgaattacggacagtactttgcgcgatcaagaacggtcggcagcaacacgttggatatagggcttacttgtttttgcggccataaccggtcacaatggcgataacaaggatgaccagcatggcgatggagtagtagtttacaaatggaactgaagcgggcgccacagcaaatgcttcgccgaattcagcggccttcatggcgggaataacgcagtgaaccgtccagggcgccaggaaacagaacacgcagcctgcacagtccatcagattggctctgcggtatggatccacaccgttcttttcgcccatctcctttaccagattgcccatagcgactatggcaaccgagataacgccggtgatcatgctcaaaatgcctacgcagccgacaatagtagcttccgtgcttgcggggccttttgccagtttggagagtccgcgtcccacatcttgaaataggccgctggattccataacgcccagcatggcaaagacaccgatgagcatggccacggtgcccatgcagccggtgatggagtcggaaaggatgccggttacactgaacccaccgggaaaagccagcaggtcgctgataagatagatgccgctcaccaggccggcagcaataccggcgacgacgccccaggccaaggctgtgatgagatgttttttcatcagacaaagagcgatgatgaccacggggaccaccagcatgatcagggagagcggcttaggctcaacctgggcggcttccagaacaatcgaactggtttcagtcttggtaaagatcaggaaacataccagtgcaatgagagcggcggggatggaatatttcatccgggaacggacgaccttgcccaattcagcattctgggttgtagcggaggcaatggtggtatccgagataggagccaggttatcgccaaatgccgctccagaggcaatggcgccaatcatataaatcggggagactccggtcataacgcccacggggaacaggatggggatgaccaccatataggtgcccaccgatgtgccggtggagaaagccagcaggcaagtgatcacaaaagtgactgcggcaaagagtttgccggtaaggccggcctggaccgcataggcggcgatcgtttgcaccatgccgcttccagagatgagtttgccggagattgcggccaaaataaccgccaaagcgatgatcgggaacatgggcttggtaagaccggagatgatggcctggccatacgctttctcgtccttggcaaaaatcacgccgaaaatgatagccatgaaaaaggctaccatatagccgttgacattggaaccgctgacagcggcccaaaggatgaagccgaccgccaccaacaggggaatcagtttgccaagggtgccaaggtgaaattccaaacgcttgttttcattcataacgacgcctcccaaacacgttactaaggtcagaagtgctgccttccgaatccctgtaatatagaaagaatcacgcttgattcagaatctgccgggagagggcttgcagggatttttccatctgctcctcgtgatactcgcttgcgggacggcaggtcagcgcaccagaagggcagacccgcacacaggcggggatcataccccggcgcagccgctccacacagccgtcgcacttttccatctttccttctgcattgaaggaaggcgcgccaaaaggacaggccatggcgcaggagtggcagccgatgcagttggtgttgtcgtagagtgtcaagccgctttcgggatctttatagagacaagagctagggcagcccataacacagggagcgtcttcgcagtgcatgcaagccaccgaaaggaaggagaatttttgacttcccccatcttctgattcaagttcagcggcattgcggaagggatgctggtgatgagccgcgtcaatatcgttctgatccatacaggccatgacacatgcaagacaggccgtacacttggaaggatcgaagtcgaaaatcattttttccatcatcatatcctcctgacggcgacccgcgtctcccggtagcttggaaaaccggaatagggatcgagaatatcattgtcggtgagcaggtttacatcagcctcgctgtatccatggtagcagcagataacgccgggttctgccttatgggtgaggtgggccttcatctgaatgctcccccggtgagaggtgagttcgatggtatcgccttcgaaaataccaagcgcctgggcgtcctcatagcttatatccgcctgcggctccgggcgcagggagcggttccatggcaccttatgaagccggctgtgaagggcgtttgagatgcgcggcgatgtgcagagcacataaggcaggtcattgtccggccggtccgctccaaagggtggcgtataagtgggaagcggatcgaagccagggtgtttttcaatagcaagggaataaagctcaaattttccgctggcagtattcagtcctttttccagcatggaacccgggacatagggtttcaggccgggcagtttcacgggcttcccggcagcccgcagctcctccaaagtgatggggagatcctgaaggatatagcgccagcaggcgtctgggccttgacggagcagctcgtcatccagattcatagcttcagccagctcgcagagaatctggatgtcactgcgggactcgcccaaaggctggatgacaggctcggtacaaaacagatagccgccgccgtagcttttcaggtcgctgcgctcaaaggaggtgcaggcgggtagaacgatatcgcagaatttgcaggtgtcagtgagaaaaagttcggtattgaccagcaaatccagcttgagcaggttttgcttcagccgctcatcgtcgggggagatgcggtaattcataccgaagcccaacatcgcatggatggggtaaggatcccccgtctcaatttgacgggaaaggtcattggcctggccctcatgaataaaatcgttccagattggaaagcgttttgcgcctacagccggggccttgacacggtcatggtgagccattatgaattcatcctcacgggtggagaatccagcgggaagatagttgtaactgaactgtatcggaatctgaccgccgggctggtcaaaacaacccagaatggcggacagcgccataatggcccgataattctggaacccattgcggtgatgcgccaagggggctgcgctctcgttgatagccatgggaagattgtcagcgatgagggcggcagcttcctccaactgttcagcggggactccggtaagctcctctactttttcgggggtgaagtcctttacataggcggcgtactggtcatatccgtagacatatttatcgatgtaactgcggtcagtcttgccatcccggatcaggatatgggccaagcctagggctacggccccgtcggtaccggtgcgcggccggagatggatgtccgctagatgaagggatgcaggcgtgatacggggatccacgatgatcaccttcatcccttcggctttccgcttttctacgttaagggcggccagatggcgggagtagtatggattaaaggcccatcccagaaaaatgcctgcattggacacatcggttgagcacatagggtttccggtggtgacccaccaattgaggaaggtggaggtcatgcagctgctggactctgtaagaaaattaggtgaaccgaaggaataggtgaaacggtgcaggaagggacgataccatttggtatagcccgagtaaaaaatcacactttccggtccgtgtttggccttgatcgcgttcagacggctggcgatttcacgataggcttcgtcccaagaaatgggttcaaactttccctcgcctcgctttcccacacggcgcagaggcgtgcgtatccgatcctcacgatagatgtactgacggttggacaggcccttggggcagagaaggccgtggttcacaggatgatcggcagttccttcgatcttgacgacctttccgtcctttacataggcgtcgatcccacagtgaaaggagggacagcagatatcgcaaagggtatgtttgacatcgatacctgtctctgcacaggggattttggctttgagcaggcgctcagtttgattcataagtgacaccttcattcagtgggctgcgttccaaaagttcgatgatggcctcgtcaaggccgctgcgcagcaggatgaccttctgcatggaactgattggttcgctgcttcccaaaaatttgcgggtcatataatttttgataactccgctgatgatatgattgtccacaatattcaccagagccagcgtaccctcctgccggatagcatacaggaaaaaaccgtctctgcggcagcggatgatctcgcctttagcccttacatcgccgaagccgatgaaatccatatccatgaaatgagtgatattgtggggcatatttccaggataatccaccggcttgcccagcatggcgccggctgcggtacggccctgatagccagcgtttgcccacaggccaatgatctgattttgtccagtctggatgttgcggccgctggcacagtctcctgcagcataaatccccggagcagaagtttccattttttcattgaccaggatgccgcggttcacctggggttcgctgccatccagaaaatccaagttagctcgggttccgatagcaaggacaacaacgtcggcatccagggtttcagttccaaaggaaacctttaaaccatccggaacttcgtcaatggcggtcaggccaacgccgaatttgagctgcacacccttttccatgactctctgtcccagttcagcccccacttcggggacggctgccaacggaaagagggagggggccatatcagcaagaatacagcgggctcctgcacgttggaaaagttcagctaccttgatacctaccatggatgcacctacaaccacagcctgcttcacattgccctgatccaaacgccggcgcagggcttcggcatcggcgggtgtacgcatgacgtacacatttttctccggcagcgcgggcagcggtggcaggaatacccgggcgccggtcgagatcagcagggcgtcgaaagtatggacgcttccatctgcaagataaagagttttccccggtgtgtccagatgaattgctgcagcgccagtgtgaacggtcagccgaagtgaacgggctatgtcgctgagcgaaccgaaagggaacagccctttccagggcagcctgtgaccggcgtaataagtcgtcagcatagggttgtatgggggcaggtcggtgtcggaaaacacatggattgccccctcatatcccaattccctcagagtttttgcgcagtgatagccggcgcagccaaagccgagaatagcgatcgttttcataatttccctcctttcaagggatcttgctaaactctttgagcatatctaaattataaataatccaacggttttgttttttctccagaaggcccatagcctcaaattctccaattacttggttcactgtcaagcgtgaggccttcaccaaattgccgataccctgctgaatgacagggagctgaaccttgatgccatcctttgtcggcacaccgaacacgtggaccagatccacaaatacagcagccacccggctcctcgcgtccagaaagcataaacggcggatgtgctccatcaagagatggatcttatgcgccatggaggagagcacctgaacattgagcgcggtatcttgggacaaatgatatagaaattgatccttgggtatacagtatagttcacagtccacgatggtggcggcgtggagaaactgcgcttccggctcaaaacaggtttcctcgccaaacataccgccgctgagagcaaaaatgtatattttttccgcaccctcgctggaaaagtaagagagccgcacccggccgcttttgacgatgtaaatatgagaaatatcctcctcctgattgtaaagaacatttttctcttttacgttgatcagatacttttcattcgtaagaggtccccattgctccaggtcgcaatagatccacggagaaaaatttttattcgtcatcacaatgatggcgcccctttccgttccccttgattttattttataacacatcacatatgcaaaaaatataaggcagcttacattattgcgccgtttgcgtgatttgcacaatataatatattatgctatattatgttaaaaattgtccagacgaattaaaaaatataagtcgtatatcgtataatttcacgaaataatgtaaagaagcttatattttttggcgttgaattatggcagaataaagtcgatcaaaattttgggaggtgcacaagctatggaattcggaattctgagtattcttccgtctatcctggcaatcgtccttgcgctggtgaccaaaaatgtgtttttggcactgtttgcgtctttgctggtaggtaactttatcctctccgggtacaacctgatgagtatgctggtggggaccaaagacatgattgtgaacgtgttttccagttcttcaagcacgtcgatcatcattatcctgctgaccttgggcggcatgttttatctgattgaaaaggcggggggactgaagggtttcaccgcgctgatgatcaagaagcgcagcatagtcaaatcccgcgtaggcgctgaactgttcacctggatcatcggcgtgctggtatttattgatggtactttgagcgtgatgatcaccggttccatatcccgccccctgaccaaagcctttgggatatcccctgaaaagactgcctggatcgtccactccactgctacccccatgtccatcttggttcccattgcagcctacggcccctatatcgccagttttatcgaggcccagggcattgagaaccccaccgctcagatggtgcgcggtattggatttaacttctactgtattttcgccgtgctcggcgtggctgctttcgtcctcttgaagaaggattttggcccaatgaaaaaggcggaagcggcctatatggcggctgctaccggcagcgtctccggcgaagatgactccgagatggcaggggatcccagcaaagccaaattcctgcttattcccatggtggtgatgatcgtggtcactatcgcatacattttttacagcggcagcggcaatctggtgaacggcgacgcggagactggattgatatttggaatcatggccggtacaatctatcttataattgcaatggcggtgaccaagatggggtctgttgtgaacaacatcagtacgtttttccaaggctgcggtaatatgatggatattgtggccatcatggtctttgcctatgctttgagcaacctgctgggcagtctgggaacggccgattacctgtctggcgtcctggtgaagcttattagccccgccatcttcactgcgattgccttcctgttcacctgcgtgatctccttcgccacaggcaccagtgccggtaccatcgcgatcatgatgcctatcctgctgcctatggcgctggcattaaatgtccatatccccatgatcgtgggtgccgtggccggaggcgctgtattcggtgatcattcttctcccatttctgatacaacgatcatgacttgctcctccacagactgtgacgtggtttctcatgtgaagactcagcttccgtattctctgtgcttcgcaggcggagcaatcgtgctgtatttgattcttggctttatcctgtaagaattttagaccaacaagagaaaagccgccgtttcggcggcttttctccataatataaaaggagcaatcatgatgtatcatttcgatgaggccattgaccgccggggccacaacagtgcaaaatgggatcggcgtttcattggcgagggcaaggatgcactgctgcccttttgggtcgcagatactgactttcgcactctgcctgaggtgaacgccgcgctggccaagtgcgtggaacatgggatttatggctatactctgccgcctgaaggctgtgctgcggcagccgcacgctggcagaaggtgcgccacgaatttgagattcaggaggagtgggtcacattcctggctggtatcgactgcgctatctcgactgcggttcaggcgtttacacagccgggggacgaggtgctgatcaatacccccatctacacacctttttttgaagtggttttggaaaatggccggcaggtagtgtccagccccatgaggttggtggatggcaggtatgagttcgacttcgaggatttgtcggaaaaagcgaaaacggcaaagctttttcttttctgcaatccgcagaaccccacctcccgcgctctctcacgggaggagctggaaaaaatcggggagatttgcgcagagaacaatcttgtgatcctctcggacgagatccacggcgacattgtgtttgacggccgtcggcatatccccatcgcctccctcagcccggaactggctcaaagaacaattacatgtacctctcccagcaagactttcagcgtggccggcttggtggcctcggtcatcatcattccaaataaggagcttcgccgccggttcgaggcagtcaaggaacgcaactgtatcaacaccaacatcctggggttggtggctatgcaggccgcctatacccacggagacgactatgccgatcaagtgacggcttaccttcaggagaatcgggactttgcaatacggttcctgcgtgagcgggtaccggctataaatccgatcgctccggaggctaccttcctgctctggatggattgcagcggtttgggcatagcctccgagaatttggagagctttttcaccggcgcgggacttcgtctttcaggcggtaccgcctatcaggaacctacgggtcagtttgtgcgtctgaatttcggctgtacccgggcaacgttgaaagctggtctggagcggctggagcgggctgtgctcgcaagaaaataatgatacggtataagtatgcgcaagagcgcaggatacaaacgtatcctgcgttcttttgttgcccattttcggggaaagaccgagagaatatacaggtaaagctgtgtaccgaagggactccctttggaaatcttggacaaaaaaacaggcggtgtgctgccctctccggacatatacagccgtttgttgccagcagtccatttcacggttttgcaaagcaaagtttgttacatcataatttataagcaggaacttttgggtgcgagggtattttgtagatatgacaggaaaatgtatagatgctctaagagtacattccgtcggtccatcttccaaggaccagcaagcgccgcctcctctgggatctgagcaaaccctaattagctggcggttttgattacaatatctatgcaggtataaaatatacgtccgcgccctttactttatccggggattattgtaaaatagaaacggtactgatcagacatttttgtaaatatttgaagctctggaggtcaaatatgccattaaagtacaaacgagtgctgttaaagctgagcggtgaggcgctcgcgggagacaaaggcttcggtatcgattacgatgttattcgtacaatcagccaaagcatccagaagtgtgttgcacttggcgcacagattggcatcgttgttggtggaggaaactttttccgcgggcgcagcagcgaccagatcgaccggacgcgcgccgatcatatggggatgcttgcaactgtgatgaatgcattagctctcgccgatggactagaagcgcagcaggttccagtacgtgtacagactgccatcaccatgcagcagatcgctgagccatatatccgtggccgtgcgatccgtcatttggaaaaagggcgcgttgtgatcttcggatgcgggacagggaatccatatttttccactgacacggcatcgtctctgcgcgcggcggaaattgacgccgacatcattcttaaggcaaccatggtcgacggcgtctatgatcgtgatccgcataaatatgaagccgctgtgcggtatgacaatgtttcgttccaggaggttctggagaaagggctcggcgtcatggacagcacagccgccgccatgtgccgcgacaacaacatccctgtacttgtgtttagcctttccaatccggataatattcttgccgcgatcagcggcgaacagatcggaaccattgttaaggaggaaaaagcagatgaatgaacgtttgaagcattacaacgaaaagatggaaaaaacgatccgcgtgttggaaaatgaatactcggcgatccgtgcgggccgtgcaaatccggcagtgcttgacaaaatcaccgtcgattattatgggacgcctacccagattcaggcgatggctgcgatttccgtatccgaagcgcgcattcttgtcatccagccatgggataaatcgacgcttaggcccatcgaaaaagcgattcaggcatccgacattggtatcaatccaacaaacgatggcacggttatccgtattgtatttccgcctttgaccgaggagcgcagaaaagagatctgtaagcaaattaaaaagcagggagaggacagcaaggttgcgattcgttcgatccgacgcgacgccaatgagaaattcaaggcgttgaaaaaatcgagcgaggtcagtgaggatgaggaaaaggatcttgaggatcagatgcagaagatgactgacaaattctgcaaacgtatcgacgagatcgccgcgaaaaaggaaaaggaaattcttgaaatttaaaaacctgtattcacagccggaggatgctgggcagacaaagagttttgtattgatcaaggcgaatttttgaagtcgggctgtcgcccggcaaaaaatttaatgccaagcgggtgcaaaaggctcgcctggacggtgtttggagactgggaataaggtactaagggcctatgaaaatatagagtacgtcggttcttcggcgggcaaatacctgccagctgcggcggactttttaccggagtgaaacaatcaaatggcaaacacaccgtttgccgatgtgccgtccggctctatgccggcgcacatcggcatcattcttgatggaaatggacgatgggccaaaaagcgcggcttgccgcgaagcgccggtcatcgccaaggtgcggatacctttggcaagatcgcgcggcattgccgagaaatcggcgtcaaatatttgacagtgtatgcgttttcaacggaaaactggaagcggccgcccgatgaggtcgaggcgctgatggatcttctacgccgctatttaaccgatacctataagcatcgtgatgagaatgcacgcctgcgttttttaggagaacgtggtccgctctccagcgatatccgagagatgatcgagcgtgtggagcatgacagcgccgccaatacggctatcaatgtgaacattgcgctaaattatggcggacgtgatgaaattgtacatgcggcgcgcgcgattgcaaagcagtgttcagaaggaacgcttgattggaaattaattaatgagcatctgttttccgagacgctatatacagccggacagcctgatcctgatttgattattcgtccgagcggcgagcagcgcatttcaaactttttgctttggcagtcggcctatgcagagtttgtgtttatggatgtgctgtggcccgatttcacacccgcgcatctcgatcaggcaattcgtgtttttttaagccgtaaccggcgattcggcggcgtgtaatgcagcggcccgtactgtgttcgggcctgaaatggagtcctttaacatgaaacagcgattgatcacctccggcatcggcttgctgattttgtttgtggtttgtgttttttttgacacagccgttttaaataccgcgatagcacttatttcgttattggcggtttatgagctgttgtccgcgacagggtgcttcaagagtcgtgcagttgccattccggcactgctttttacggcaattattccatttttaccaatgcagtgggcgatgcggtacattgtaccgatctgctatatttatgtggcggctttgtttattgcgctcctgcgtttccatgaaaaattgcatatcgaacagattgcaatgagtttcctattttgtctggtgattccgttttctttgacaacagtggtctatatccgtgacagacatggaatgtggcttggtattttttatgttttgatggcgctgggcggcgcatggctttccgacacaggcgcctattttaccggcagggcgtttggaaagcataaactcgcgccgtatatcagccccaaaaaaaccgtggagggcgccgttggcggggtaatattcgcagaagcggcgatgcttctgttggcgtggctttattccttggcagccgatgcgcttggacatccgattgttgtgaattacgccgctattttgatcgttacaccggtgctgtctgttttcagtattgtgggcgatttgtccgcgtctgtaattaagcggcagtataaagtcaaggattatggttccatcatgccaggacatggcggaatcatggatcggttcgacagcgtattgatggtggccccgcttatctttatggcaagccggtggtttccgctggcgcatctgtaatttgacggaaaagaggcatttctttgacgaaaaaaatcgcgcttctgggagcaaccggttcaatcggtgtccagacgttggcgtgctgtaaagcacttggatatcggattaatgtccttgctgcaaacaagagcgttgatctgcttgaacaacaggcgagggaattttcccctcgctgtgttgtcgtttcagacaaaaatgcatatacagacataaaaatgcgtctggccgacctgccggttcaaattctggctggtgtcgatgggatgtgtgaagccgccgcgctacctgaaaacgatgtcgtctgcaatgctgtcgtcggtatggtcggcctgcggcctacgcttgccgcgatcgaggcggggaaaaccgtcgcgcttgccaacaaggaaacgcttgttgccggcggacagcttgttatggaggcggttgcccggacaggcgttggcctgctgccggtcgacagcgaacatagcgcaatttttcagtcgcttcagggaagcagccgcgccgacctttccaaaatcattctgaccgcttccggcggtccgttccgtgggaaaagcactgcggagcttgaacacgtttcgctggctgacgccctgcgtcatcccaattggtcgatgggggcaaaaattactgtcgattccgcaacgctgatgaacaaagggcttgagtacatagaagcaatgtggctgtttgggctgacgccggagcaaatagaaattgttgtgcatccgcagagcattatccattcggcggttgaattctgtgatggagcggttattgcacagcttgggactccggatatggctgtccccattcagtatgcgctgacctggccgcgccggatgaaaacctccgccaagagattatcacttgcagagtatggaacattgacctttgaacgtcccgattatgaaacatttgcttgtctgcgctatgccattgaagcgatccgtcgcggcgggctttacccctgtgccgtaaatgctgcaaatgaacaagccgttgcgctttttttggacaacaagattggtttttcaaaaattgggcttgcggtaggccatgtgcttgaaacaattccatgtaaaggcagtaagcagtacaccgtgcgggagatcgatgaaacagataaaactgcccgtgaactcgttctggaatattgtaaaagcagataagaatactataaaaaagaggatggttttacgtcctgattacagcgtcccggcgggctggggcgctatggcatggtgaggaacttgaatttatgagcattgtttttcaggtgatcgtcgcaatccttgtatttggcctcttgatatttgtccatgaactgggacattttacagtcggcaagctttccggaatgcgcgtcaatgaatttgcgctgggtatggggccggtgctttggtcgcgcacgcgcggtgaaacaaaatattcgctgcgggccttgccgatcggcggttatgtctcggtcgagggggaggacgaggacagctccgatccgcgcgcgtactgcaacgtgcggctctggaaacggattttgtttgtctgcgccggcgcggcgatgaacctgctgcttggatttgtgatcctgtctgtgcttgtctccatgcgcacatctttgcccaccaccatcatctatgagctgcgcagtccgcaggcagccgcgtcagagcttcgtgtcggagacgaggttatcagtgtcaacgggcaccgcgtctttacttcgaacgacatctccttttcaatcgtcagcgacaaggacggtatcattgattttgttgtgatccgcgatggccggaaggtttctgtgcccggcgtcaatctcggcatgaccattatggaggacggtacgcgtatcgtcgatccgggatttgtagtggacattacgcctaaaacattctggggcagcgcacgttacgcggttctttggatgttttcaattatccgtcaggtctggctgtcgtttatcaacctgatcacaggtaactttacgcttgcggagttgagcggcccggtcggcgtttctactgtgatcggtcaggcgagcacggctgggcttaagacgctgctgttgctcgtgggatttattacagtcaatatcggcgtgtttaatcttctgcccattcctgcgctcgacggcgggcggcttctgtttttgctgatcgagctggtcattcgcaggccggtcaatcaaaaatatgaaagcgttatccatgcggcgggttttatccttctgatgggcttgatgcttgttgtcaccttcaacgatattctgaggtttttctaaatacagtccggtaatctctgtaaaatggcaaagtttcagagaacccggagaaaaggagctttcatgacaaggacggttcaaatcggatcagtaacgatcggaggaggcgcatccatcgcggtgcagtcgatgcttaacagaccggcgtcggatgtctcaggaaatgttcgccaggcgcgcgcgcttgaggcggcgggctgcgacattatccgcgtcgcggtccctgaccgcgcgtcggtccggctggtggagcagatccgcagcgcggtgcgtattccgcttgttgctgatatccattttgattaccgcattgcgcttgattgtgtcgcggcgggcatcgataaaatccgtatcaatcctggaaacatcggcgacgacgcgcatgtgcgcgccgtcgctgacgcatgtgcggctgccggcgttccgattcgtatcggcgtcaattccggttccctggaaaagcagatccttgccaaatacggcgcgccgacaccgcaggcgcttgttgacagcgccctgtatcatgcacggcttttggaacggtttgactttaacaacattgtcatatcaattaagtcgtcaaatgtcccagctatgatcgcggcataccgcctggccgcggcgcagatggattacccattgcacctgggcgtaacggaggccggtacgcgccgcatggggattatcaaatccgcagtcggcatagggtcgctgctttgcgacgggatcggagatacgatccgggtctcgctgacagacgacccaatcgaggagattagggccgcgcgcgatattttgaaggctgttggaaagggaacaggcgttgaaatcgtttcctgtccgacctgcgggcgcacacagatcgatctgatcgcacttgcagggcgtgtggagaaggctttggcggaatgtaacaaaccgatcaaggttgctgtcatggggtgtgcggtcaacgggcctggcgaagcgcgcgaggctgatatcggtattgcgggcggaaacggcgaggcgctgctctttaaaaagggcgtaccgtacggaaaatatccggaggagcaaattctggacgtgcttctggaagaaattaggcggatggagcctgaaggagtgtaaaaatttggcgtccctgatcgaactgttcggcgaatacatagagctgccgcccggtgcgcttgcgcgcgggacggtacttggcatgcagattgaccggcagaaacggtcgatatgcgtttcgcttggtttggacgagctgacgccgtatgctgcgctttctgagcttggccggcgtctggcggcggcattctccttaaacgatgctgcggtccacccgcgctatgacggcggcatgctgtcaagcgagcatctgccggaattgattgcgcgtctgggcagcgaaggcgtgccggtcaacggtttttttaccggctgccgatgtgatttgattgatgaaacgctgcgcatctatctgacgcatggcgggcaggaattcctcgaaagcatccattgcccgcaaaagctttccgcggtcatacgcgaggaattcgggcgcgaggtgcggattgtattcgacggcgtgctcgaggtcgcgcctgacagcgcgctgtatcaggaaacagttgaaaaggtgcgtcccaagccgatcaggtatacgccgcccacgccgcagcaggcggaaaagaagccggagaacggcgcggttatcccggcggcggcgcgcctttccttcgatgcgcacgatttgccgtttgagcctggttccatggtcacgctttacggaaatcccccgaagggacgccctgtggagatggcgcaggtgaatattgaaagcggcaatgtgacggtatggggcgatgtgttcaaaattgaccgccgtaccagccgcgatgaaaagacgctcattttgtcgatttattttaccgattacaccggctcttattgtgcgaaggtgatcggccggtttgacaagaagatgaaggcgctcgacgagctgcacgagggcgatacggtcgctatgcatggcctgatcgaatatgaccggtttgaccgtgaaaatgtgatgcggcccgacagtatcgcgactgtgaagaaaatcccacggcgcgatctatgcgaggaaaagcgcgtcgagctgcacatgcactcaaacatgtcggcgatggacggcataacacccgcggccaagctgatcaagcgcgcctacgaatttgggcacaaggcggtcgcgatcaccgaccatggcgtggtgcaggcatttccggactgcatgaacgccgttgccaaaatccgcaagagcggcggcgatatcaaagtgatctacggcgtcgaagcctatttcgtcgacgacgtggtgcaggctgtcagcggtaatgcgcacggcgggtttgacagcgagatgattgtatttgacctggagacgaccggcctttccgctgcgactgaacgcattacggagatcggcgcggtgaaactgcgcagcggcgaaatcgtcgaccgcttcaacacatttgtaaacccggagcgttcgatcccgccgaagattacagaactgaccggtatcaccgacgacgatgtgcgcggcgcgccgctcgaaggggaggcgctgcgccaattttatacgttctgcgggagcagcagcgcggtgctgatcgcgcataacgcgccgtttgatacaagctttctgcggcagtgcgcccggcgctgcggcatggaatacaattttactgcgattgatacggtcgtgctgtcgcgttccttgtttccggagctgaaaaagcataagctcgatatcgttgcaaagcatcttgggcttggcgagttcaatcaccaccgtgcatgtgacgacgctgaaatgctcgccaggatctacatacgtatgatggagctgatgcagtcggagcgtgcatgcagcgatattggacaaatcaatacatcgcttgctgcggtcgacgtcaaaaaatcgccgacatatcatcagattatcctggtaaagaatctgacggggttaaaaaatctataccgcctgatttcaatttcccatctggattactatgccaaacgtccgcgtatccccaaaagcaagctgattgaacatagggagggccttttgatcggaagcgcctgtgaagccgggcagctttaccgtgcgatcgtggaggggaaaagctggggcgacctgtgcgatatcgcgcgtttttacgattacctggaaatccagccggttgcaaacaacgaatatatggtgcgcagcaatatggttgcggacgagcaggcaatccgggagtttaacgaaacggtcgtgcggcttggagagcggctgaacatcccggttgtcgcaacctgcgacgtccacttcatggacccgggcgacgcgaaattccgggcgatcctgatggcgggcatgggctttgccgacgccgaccagcaggcgccgctgtattttcgaacaaccgacgagatgctcaaggaatttgaataccttggcgcgcagaaggcgcatgaagttgtcatagagaatccgaacctgattgcggatatggtggaaaatatcaagccgatcccggacgggacgtttacgccgaccatcccaggctccgacgaggatttgcagcgcatcacgcgcgccaaagctatggagctttacggttatcaggggcaggtgcctgaacttgtgtccaagcggttggagcgcgagcttggctcgatcatcaagcacgggtttgccgtgctttacatgatcgcgcagaagctggtggccaaaagcgaggaggggggctatcatgtcggctcgcgcggttctgtcggttcgtcgtttgtcgcaacgatggccggcatttccgaggtcaatccgcttcctccgcactactactgcccggactgccattacagcgaattcatcaccgacggttcggtcggctccggatttgacctgccggaaaaagcctgcccaatgtgcggcgccatctataagcaggatgggcacgatatcccgtttgaaacgttcctcggttttgacggcgataaggcgcccgatatcgacctgaacttttccggcgaatatcaggcgcagatccataaatatacggaggaattgttcggcccaacgcacgtgttcaaggccggcaccatttcgaccgttgcggaaaaaacagcctacggctttgtcaaaaaatacgcgcaggagcgcgggctgattatgacgcgcgcagaggaggagcgtctcgcgatcgggtgcaccggcgtcaagcgcacgactggacagcatccgggcggcatggttgttgtgccgtctgaccatgaggtttttgatttttccgcggtgcagcggccggcggacgatccgagctctgatattacaacgacgcattttgatttccattcgctgcatgatacaatcctgaaactggatgagctgggacacgatgttccgacgatgtataagtatctcaaggacatgaccggcatcgacgccaatgacgttccgatgaacgaccagaaggttatgagcctgttcctctcgccggaggcgcttggcgtcacggaagaggagatcgactgcaataccggtacgctcggcatcccggaattcggtacaaattttgtccgcggcatgctgattgaagcgcagccgaaaaatttttcagacctgctgcaaatttccggcctgtcgcacgggacggacgtctggctcggaaacgcccaggagctgattaaaaataaggtttgtacgatttcaaacgtcatcggtacgcgcgacagcatcatgacgtatctgctgcacaaggggctggagccgaagatggcgtttaagatcatggagattacccgtaagggcaacgcgccgaagctgcttacagaggaacacatgaccgccatgagggaacacggcgtaccgcagtggtatatcgatagctgtctgaaaattaagtacatgttcccgaaagcacacgccgcggcgtatgatattgcttcaatccgactgtgttggttcaaggtctatcaccctctggcattctacgcggttatctttacggtgcgcggcggcgactttgacgcggaagccgccgtgcagggcaaatcggccacgaaacgcaagatacaaaacctgctccagatgggcaacgagcgaacggccaaggacgagggtgttttgaccatgctccagatcattcacgaatgccaggcgcggggctattcctttttaccggtcgatctgtataaatcgcattacagcatttatgaggtggaggacggcaagatccgcctgccgtttatggcgctcaagggcgtgggggaggcggccgccaggagtctgtgggagacggccaaaaccgagcagtttatctcagcggacgatatttcaaaccgcgcgggtgtttccaagtcagtcattgaaatgctgcgtggagcaggcgcgctcggcgatttgccggaaacatcgcaggtgtcgtttttttaacagccggcatggtgtggttctattgacaatttggatttagtgtgataacatattagcatagtaaagtaaatcgcatcgaggaggctctcatgaggtactacgacaaggtgacgcccgacgggacccgtgacctgctgtttggcgaatgcgtttcgcgcggggaggctgtcagccgccttaccacgatgttccgcgcgcgcggctaccggcaggtcatcacgccggcgatcgaattttacgatgtgttcggttcctccgccgcgcattttccgcaggaaaatatgtataaactgaccgacacgcgcggccggctgatggtcatacggccggactgcacaatcccaatcgcccggctggtggcgacgcgtctggcagcctccccgatgccgctgcgcctctattacagtgaaaacgtttatcgtgtggagcatgatctgcgcggtaaacgcaacgaggtgtttcagaccggagtggagctgattggttccaatgcgctgcgcagcgatctggagatcgtggagctggccgcctcggggctttcagacatcggcggggagcggttccgcatcgagctttgccatatcggatacttcaaggcgctgatcgacagcttggacgcgccgggagagacaaaggaacagatccgtcagtgtatcgaacaaaaaaattacccggcgctcggcgacctgctcgatccgtttggggcggcgcgcgcggcgctggcgctgcggtatctgccgcggctgttcggcggcgaggaggtctttgagaaggcgtatgcgctttttgatgagaacggcgcgcgtgagagccttgactatctgcgttccatttacgattatctgcgccagcttgggctggaggacagcgtgatcgtcgatttggggcttgtcaaccagatcgaatattataccggcatcgttttccgcggttattttgacggcatcggcgaaccagtcctgtccggcgggcgctatgacaatctgatcagcgatttcggcgcggcgcttcctgcggtcggctttgctgtcaatgccgatctggcggctgcggtcattgaaaagcagccgcctcagacgccggatatcctggtgttttccgacgaagcgcatttgccgcaggcggtcaactatatccgttcgctgactgacaacggccttgtcgtggaaagcagcacgtttgacgactatgacgcgtcggccgactacgcgcgccgccgtggtatccgtcagcttcatgttgtggatgacgacattgaagtggttgatcttgtaaaaatgcagcgggagggacgtacgtgatgaagccgatccgaatcgccctgacaaaaggcaggcttgaaaaggacagcattgcgatgttcgagcgactcggctacgactgcacggcggtccgcgaaaagggacggcggctgattctgccggtcgcaaatgcgaatatggaggttgtgctcgccaaagcggccgatgtggcgacctatgttgaaaatggcgtctgcgacattggtattgtcggcaaggataccatcatggagatgggcggaaccttttatgaggtggccgatcttggattcggccggtgccggttcgctctggctgcgccggagggcgtggacttttacgcagggtaccacacgcgctgtgtcgcgtcaaaatatgtcaatgtggcgcgcgctttttttgaacggaagaatatggacgtcaactttgtaaagatcgagggttctgtcgagctggcgccgatcctggggctgtccgatgcgatcgtcgatattgtcgaaacgggcgcgacactgcgggaaaacgggcttgtcgtggcggaatatatcaccgatgtcagcgcgcggctcatcgtcaatattgcaagcctaaagctgcgcaaggcggagatagagccgtttatttcagagattgaacagtacttggccggggaggacgacgcatgatcaggattgtcagggcggacggaagcgcggaacgcgcgctgcttgacacgctgcgcgcgcgcagcggggaggtcgacaaacaggtgacagccgccgtcacggagattattgaagcggtgcgcgactgtggggatgaagcggtgcgcgcatttacaatgcgattcgacggcgcgtgcccggatacgtttgaggtgggccgtgacgaaatcaacgatgcgctgaccatggcggagcctgaatttgtcaacgccctgcttgccgctacggaacaaatttctgcatttcatttgcgccagaagcagcagagcttcattgacacgcatgacgacggcgtgatgatgggtcagcgcatccgtggattggcacgcgtggggctttatgtgccgggggggacggcggcctatccgtcgtccgtgctgatgaactgcatcccggcgcgcatcgcgggcgtgggtgaaatcgtcatggtcacgccgccgatgaaggatgggcgcgcaaatcccgatattctcgcggcggccgcaattgcgggcgtagaccgggtgtttctgatgggcggcgcacaggctgtcgcggcgctcgcatatggaacaggaagcgtgccgcgcgtcgataagatcgtcggaccgggcaatatctatgtggcaacggccaaacggctgttgtacggcgttgtcgacatcgacatgatcgccggtccgagcgaaatcctcatcgcggccgacgacaccgctgaccctgtctatctcgcagcggatatgatgagccaggcggagcatgacgcgctcgcatcggcgatcctgctgacgacaagcgaacgcatcgcccagcaaacagccggcgagcttgaacgtcaggcttccgcgctttcgcgtgccgaaattatccgccagtcgctcgaaaattacggcgcgatcatcatttgccgctgtccgcaggaaatgatcgacctggccaacgagcttgcgcccgaacatatggagatcatgacggaaaatccgctcgaatatatcggaaaaatagacaatgttggctctttatttttgggtaaatattcgcccgagccgctcggcgattactatgcaggccccaaccatgtgctgccgacctccggcacggcaaggtttttctcaccgcttggcgtcgacagttttgtgaagaagtcgagcttcgtgtattatacgaggcctgcgctgatggaagcgcaagggcatattgtgcggattgccgagcgtgaagggcttacagcacacgcgaattcgattaaagtgaggttttccgatgtctgatcaaacggcttatgagctgccggaaaaactgaaaaacctggcgccctacgcgccgcttgagggtcttttcaacatccgtctcgacgcgaatgagagctttctttcgccgccgccggagctgctttccgagtttgcaaaggcaatttgttccatcgattttaaccgttatccggacccatactgcacagagctttgcgaggcgtttgccggctttttttcggttgcgccgtcacatgtggtcgcgggcaatgggtctgatgaattgatcggcttaatcgtcaactggtttacgaatccaggggatgtgatgatcacggtttcgccggatttttccatgtatgctttttacgcgcagccatgcggcgtgcgccatatcgcgttggataaggacgcattttctctggaacttgatgcggacagactgatccagacggcacgggagaacaacgcgcgtcttgtgatgttttccaatccctgtaatccaacttccctgtgcgcctcgcaggatgcggtgcgcagggtggtggaggcgctgcccggttgtcttgttgtcgtcgatgaagcgtatatggattttgccgaaggttctctgctttcgaaaaccggaacatatcggaacatgatcgtactcaagaccttttcaaaggcgttcggaatggcggcgatccgcttgggttttgccgtcgcgcatccgacattggcgatcgcgctcaaggccgcaaaatccccgtataacgtcaatacaatgacgcaggcggtcggctgtgtgctgctttcacatccggattacattaagtcctgtatcgaagacatcaaacggtcgcgcgatgatctgcacagccggttatgcacgcttgccgcagccaaggatgatatcctgggcgtttggaatacgcaggccaattttgtcctgctccggctgtccgatgcgcgggaaacagccggccggatggcggcgcgcggcgtggcggtgcgcaatctcggcgattatctgcgggtttcggcgggcggcccgccggaaaaccgcgctgtgattcgtctgcttgacgaaatcctgcattgattgtataggaggggaaccggatgcgtgcatgtaccattcggcgtacaaccagggaaacagatattgagctgtcgcttgacctcgatggaacaggacgcttttccgggtcgtccggcatcggctttttcgaccatatgctggaggcgttcgcggtgcatagcgggtttgatttgacgctcaatatgacgggcgacttacaagttgactgccatcactctattgaggatgccggcattgtgctcggacaggctttctcaaaggtgctcggtgacaaaagctctatcgcgcgctacggaagctttttcattccgatggacgagacgctcgccttctgcgccgtcgatatcagcggccgtccgtttcttgtgtttgactgtgcgtttacaaaccagtcggtcggtgcgttcgattgctgcatgacaggcgagttctttcgcgcccttgcctttggcgccggtatgacgctgcatctgcgcgttttgtacggtgaaaacgatcaccacagaatcgaggcgctgtttaaagcggcggctcatgcgttaaaagaagctgttgtaccgagagacggcggcgtcctctcctcgaaaggggtgctgtaaggtatgattgcgatcgtcgactatggcgccggcaatctgttcagcgtgcagaatgcgcttgcttatctgaatattacctgttgtaccacagacgacccggctgttctggaaatctgtgacggcgtcatattgccgggggtcggcgcattcccggaggcgatgcaccggctgcatgcgtcggggcttgtatcgatcatctgtgaacaggcgcagaaaaagcctttgcttggtatctgcctgggtatgcagatgctgtttgagcgcagctatgaatttgaggaaacgcaggggcttggattaatccccggccaggtacgcctgattaacagcggcgggctcaaaataccgcatatggggtggaatgatttgacagttctccatccttgtgcattgacagagcattcaaaaaacggggaatatgtctattttgtacattcttactgcgttcacacgccggatgaaaatgtctcctgctatacggaatacggcgaacgtatccctgcgcttgtacaccgtggttttgtctatggcgcgcagttccacccggaaaaaagcggagaggtggggcttgcgatgctgaaaaattttgcgaggttatgccaatgattattttacctgcgatcgatatcaaggatgggtgctgcgtgcgccttcgccgcggggattttgcgacagcgcacaaagtagcggaggatgcggtacagacagccgcggcgttcagtaccgcaggtgctgcgtggattcatatggttgacctcgacggcgctaaagagggcggtgcaaagaatgaacatattttcttggaagtcgcccggcacagcggccttcgggtggagcttgggggcggtatccgggatatgtctgcggtggaacgatatttggaaaagggaatttcgcgtgtgattctcggttcggctgccgttaaaaatcctgtattcgtcagggatgccgtccatgcgtatggcgaccgaatcgctgttggtatcgatgcgcgggacggcatggttgcgacggagggctggctcgatacaagcgcactgcattatattgatttggcgcggcgtatggaggatataggtgtaaggtatattatctttacagatattgctcgagacggtatgctggagggtgtaaaccttgaacagctttctgcgttgcgcaaggctgtttcttgcaatatcatcgcgagcggtggtgtacgtgatcttagcgacgtagaagcctgtacagctctaaggctttacggcattatttgcggtaaagcgctctataccggcggccttgatctgcgccgtgctattgaaacggcaggtgagcagacatgctagccaaacgaatcatcccttgtctggatgtgcgcgacggcatggtcgtcaaaggcgtcaattttgtcggaatccgcgaggtcggtgatccggtcgaatgtgcgatcgagtatgatcgtcagggagccgatgaaattacctttttagatatcactgcgacgcatgaggggcgcggaacgatgctcgatgttgtgcgcaatacggcgcgcaacgtatttgtaccccttacagtcgggggaggtatccgctctgtcgacgattttcaggcgcttttgcgcgccggcgccgataaggtttctgtcaattcagcagccgtgcgcaatccgcagctgatccgagaggccgccggccgttttggcagccaatgtgttgtggctgcaattgatgcgcgccgtaaagcggatggagacggcttcacggtcgtggtgaatggcggacggatcgacatgcagcgggatgctgttgaatgggccaaaacatgcgagcgtctcggcgcaggtgaaattttgcttacgtcaatggatacggatggatgcagaaatggttttgatctcgatctgacaaacgctgtttcgcaggcggtttccatccctgtgatcgcttcgggcggctgcgggacgctggagcatttttcagatgtatttgagcaaactggcgcagatgcggcgcttgccgcttcgctgtttcattttcgggagctgacggtcgggcaggtgaaggtgcatctggctggatgcggcatctcagtcaggaggccatgatgcacaatctggagctgtattttcaaaagtcggaattgattcctgcgatcgtacaggagaagggcaccggagaggtgctgatgctcgcttatatgaaccgtgaaagcctgcaaaaaacatttgaaacgggctatacttggttttacagccggtcgcgtcaggaattatggaataaaggcgcgacatcgggccatcttcaaaaggtggtggatctgcgcgccgattgtgacgacgacacgttgcttataaccgtcgaacaaacaggaaatgcctgtcacaccggcgcgcatagttgcttttttaaggaaatttggagggaagataaatgaacgatgttctcaaagggctttatgacgtgattctcagccgcagagacgcgccgcaggaaggctcctatacttgttacctgtttgaaaaggggcttgacaagatcctgaaaaaatgcggcgaggaatgcagcgaagtcatcattgccgcgaaaaacggcgtcaatacagacaccgaggaggagatctgtgatctgctttatcatttgcttgtactgatggcgcagcaggatattcgtcccgagcgtattgaagaaattcttgaggcacggcgtcaaaaaattggaaatcttaaacagtttcatcagagtgaccataacacataaagagaggggcggcatatgccgcccctctctttatgttcagcttatccgtttatccgtaagaagcttggaccgagaatactttttcaagcgcatggacacagtccatacagcacgcctggggaatcagaagggagatatcaacctcgcttgttgtgatcagcatcaggtctgcgccgctctgtgccacggcagagacaacagacgctgcgacgccgcaaagctcgcgcatctgatcgccgtataactggattttacagtttccattgctcatcatcggccgaacgcttggatgcgcttcacggaaatggttcaggatgtcaagaaccgccagcagatcgcaggaagggatcgtgaacgaaagatcgactgtccgaccctgtggcgccgtctgactgatcatatcgacgttaatcccagcggatgcgagatccgaaaaaacacccgccatgaccgaagggtccgtcggcatccggcaaaaggtaacaagcgcgacatcctcgctcacagttatttttgtgacgcccacaccatccatagacaatcgttcctttcattcattttactgcccagccatcccggaaaccagatcgcccatattgtaaagtccatttggacggccgcacaaaaacagcgccgcattgatgctgcctgttgcaaatacctctttactcatcgcggtatgagacaacgtcaacacctcgtcgcgtcccgcaaatagaatctcatgttcgcccacaattgttccgccacggaccgcatggataccgatctcatcttttgtacgcttttcccgcatgacatgccggtcatagacatacttcggacgtttttccaagacatctgaaacggcgtcagccagcatgagtgctgttccgctcggtgcgtcaattttttgattgtggtgtttttcgataatttcgatatcaaattgcccgcccagtacggcggccgcctttttggcaagttccataagcaggttgacgccaagcgacatattggcggtaaagaacagcggtacggatgtggatattttacggatttgttctgtctgagcttgcgaaaggccggtcgtcgcaattactgccggaaggtgcgcggcggcggcatattgcagcagcggttcaagcgcgtcgggatgggaaaaatcaatgatgacatccgcttcaaccgcacaatcggacggtgcggtaaaaacaggaaaaccatcaagcggacggccgcacggatcgatacccgccacaatggtacagtcccttcgctctcgaacgcatcctgcgataatgcgtcccattttgccattgcagccggacaacaggattcttttcatttcaacctcttttaatatatcatcagatttagggcttgtttgaaacagagaaaattaccggattgttcgcaaactgcggatgaatgcaaggcagaaaatacagaaaccctttcagattccggggctttttaacgtggcattcgctgctgcttgcagaaaaagacggtattccaattttcaaacagccccttacgtcataacgataggaattgtttgagaatagtccttaaccttactgtcagataagacccgctgctctcatttctctggatagcagttctttgtgctccggatccagttcgacaagcggcaaacggcacatgccggcatcccatcccatcatgcagacagcctccttgacaggaatcgggttcacatcacagaataaagcgttgatcaagggaagcagtttaatctgaaggtcagcgctttcgcggactttaccgtcaaaataaagctgacagatgtcgtgcgtttggcgtggcgcaacgttcgacaacacagaaatgacgcctttgcctccaagcgacagaattggtacaatctgatcgtcgtttcctgaatagatatcaagttcgtcgccgcacaaactgcggatcattgcaatctgcgagagattgccgctggcctccttggtagctgtaatgttcggatgcttacacagttcctgatatgttttcggctgtatattcacgccagtccggcttgggacattgtagagaatcacaggcagatcggtcgcatcggccaacgtcataaaatggcgcacaagtcccgcctgggatgttttgttgtaatagggcgtaacatgcagcagcgcatccgcgccggcctgtttcgcttcacggctcagccagagcgcataatccgtatgattgcttccggcgccggcgacaaccggaacacggccggcggtgcgttccacagcgaaccggatggattggacatgctcctcgtcggtcattgtagaagcctccccggtcgttcccgcaatcacgatcgcatccgttccatgtgcaatctgatcgtcaatcagggttccaagcagttcccagttgatggaaagatcggggttcatcggcgttacgatcgcaacacccgcacctgtaaaaattgttttcttcattgccgttcgtccctttccataataacgcttgattaaaggcaggagggtaacagagatgacccggttaccaaacagttttagtcaaaatacccgttcgctgccagcagctcggccaaaagaacgccgccgccggcagcgccgcgcagcgtattgtgagagaggcagacaaatttgtaatcgtactgcgtgtcggggcgtagacggccgatcgacacagccattccgttttccagattgcggtccagctttgtttgcgggcggtccgcctcctcaaaatagtgcaggaactgctttggcgcgctgggcagctcgagcgcttgaggagcgccggagtaggaggaccatttttcacggatctgctccattgtcggcttttgattaaatttgacaaatacggcggccatgtgtccgtcggaacaggccacgcgcaggcattgagctgtgatggaaggagaaactgccgggacaatggagccattttcaacacggccccatattttcagcggctcctgctcgcttttttcttcctcgccgcctatgtagggaatcacattgtcaatcatttccggccaagtatcaaatgtcttgccggcgccggaaatcgcctgataagtgcagacaagcgcctttgatacgccaaaatcagccatcagaggatggagcgccggcacatagctttgcagcgagcagtttgatttaaccgcgataaaaccgcgcctggtaccaaggcgcgcgcgctgcgaggcgattacatcaagatgcgcatcgttaatctctggaatgaccatcggaacatccggtgtgccgcgatgcgcagaattgttggaaacaacagggcattccgcccttgcataacgctcctcaagcgcgcggatttcgtcctttttcatgtctacagcacagaaaataaaatcgaccttttggactacgctgtccacatctgatgcatcgagaacgaccatttcggccgcttgctccggcattggctccgccatggcccaacgcgctccaaccgcctcgcgatatgtttttccggccgaacggggagaggcagccagtgcggccaattgaaaccaggggtgctgctccaacagagaaacgaaacgctggccgaccataccggtcgcaccgacgacgcctacacgatattgtttcataatccttcatacatcctttcaaacagtacgccggaacagtgccggcatccggcatctgctgatcaaaattacagggccgtatggctaaaattaaccttatgccggctgacgaaaccacgcttgcagacaggtgtatcgcattttatcaaaccggcccggcttttttataaattgcagcgcaatctataaaaaaagccggttgaaaaccggcatggattgtactataataaagaggttatcgattcgttccggcagacgccagtccgtccgccagccgtctccatagcactccatcatagtacaatgatgacagtcgcatgcttgttcagccatgcgcccagggcaacgcttgccatgcattcccttcggcgtctgtccctttcccgcggatttttacgaccttggcagtctgattccggatacttatgaaagacgcgcctctaccggttcggctaattagcattatattatcattataatggaattatgtcaatcggttttgccgatttactgtaatgaatttcaggcgattgccgcctataggaggaattatcacggatgaaaacgtccgattttttctttgaattgcctgaacggcaaattgcgcagacgcctatcgagccgcgcgaccattcccgaatgctgtatctcgatcgtcaaacaggcgcagtgaagcatctgcacttttatgatctgcctgattatcttgacgcaggcgatacgcttatcgtcaacacatcgcgcgtaattccggcgcgcctgtatggcgtcaaggagtattcgggcgggcacatgcagtttcttttgctggagcaaaaggagcgcgatatttgggaggtcatggtcaagccaggcaaaaaagcaaaaactggagcgcggtttgtatttggcgatggattacttgtcggtgaggtgctgcaaactgttgaaggcggcaatcgccttgtgcgtatgtattatgaaggtccaagtatttatcctgttttagaaaaaattggaaatatgccgctgccaccctatattacagccgaactttcagatcgtgaacgttatcagactatctattccaagcagcccggttccgcagccgcaccgacagcaggcctgcattttacgccggaactgatagaccgtttgcgtgaaaaaggcatcaatctcgccaatgtcgtgctgcatgttggaatcggtaccttccgacccgtgcgtgttgaggatgtcacaaagcaccatatgcattccgaacactattatttgccgcaggaaacagccgatctgatcaatgaaacgcatgcacgtggcaaacgcgtcattggcgtcgggacgaccagttgccggaccgttgaatcggttgcttcaaaatgcggtgaaataaaggcggacgaaggggatacgagcatctttatctatccgggctacacatttaaagtgctcgacggtttgattacaaattttcatctgcctgaaagcacgcttattatgctggtcagcgcgttcgcaggctatgagcatacaatggaagcctatcggatcgcggttggggagaattaccgttttttcagcttcggagacgcgatgctgatcctttaaaagccattacaatagacaactagagggggagagctttgtacaaattgctaaaacaggaaggtcacgcacgccgcggggaattcaaaacggtgcatggaacagttcagacaccggcattcatgaatgtcggaacgtccgctgccattaagggcggcatttcttctattgatctggtcgaccttaagtgccaggttgagttatgcaacacctatcatcttcacgtgcgtcccggcgatgatgtgatccgggccatgggcggcctgcatcagtttatgaactggcatagacctattctgacggacagcggcggatttcaggtgttttctctggcaaagctgcgcaaaatcaaggaggaaggagtcacatttgcatgtcatctggatggtaagcgcatttttatggggcctgaggaaagtatgcgcatccagtccaatctcggttcgaccattgcgatggcgtttgatgaatgtattgaaaatcccgctccatatgactataccgaacgttcgatcgcacggacgacgcgctggctggcgcgatgcaaacgtgaaatggcgcgtctcaacgagcttcccgatacgatcaacccaaatcaaatgttgtttgggattaatcaggggagcacgtatgctgacctgcgtatccgacatatgcaggaaatcgctgcgcttgatctgaacggttatgcaatcggagggttggcagtaggagagactgcacaggagatgtacgatacgattgaagcggtcgagccgtacatgcctatggacaagccgcgctacctgatgggcgtggggacgccggtcaatatactcgaaggcgtttatcgcggcgttgatctgtttgactgtgtgatgccaagccgtaatgcgcgccatgggacgctgttcacttgggaaggtatccggattatgcacaacgaaaaatataaaacagacagccggccgcttgatgaacattgtggatgtccaacctgtcaaaattacagccgcggatatttgcggcatttgttccgtgtcaatgaaatgctggcgatgcgcctgggtgttcagcacaatctttatttttataatacgctgatggagaaaatacgggaggcgcttgataccggaacctatgaagctttttaccgaacatgggttccaatccttggtaaacgtatttgatcagaaaagacggcagattttacttgcaagacatgtccgaaaccgctataatagtattcgtaacgtttcaaagcgtgtacagattttgggaggtattagtttcatgaatgatcaaaccacagcaaccatgatgtcccttttgccattaatccttatttttgttattttttactttatgctgatccgtccgcagaaaaagcgggacaaggaaactgcgcgtatgcgtgcgaatctggaggtcggagacgagatcgtaacggtcggcggtatcattggcacggttgttgtaatcaaggatgaccacctgattattgaaaccggttctgatcgcagcaaggtacggatcacacgctgggctgtccaagccaacaacaccccgcatgaggtcgcaactacaaaaaaataagcaagcttgggcatatcgggacgttcaaatgaataccctttttatatcaaagggggagttggagtgaaacagcccgatattcatggcgcgaagcgttttattcgaccggtaacctacggccttttattcggtgtgggcgcatgcttgcttttgttggttttgatgtccgttgtgatgaccttccgcgatgttccgcagcctgcgattacgttgatcgccacactggcgttcgtcttgggagggcttgtcgccggttttgtaagtgcgtcattcgcccgagaaaagggaatgctgatcggtgtttgctgcggcatttgcctgtttttgattctgatgactgccagctttgtatttgatgacgcgggatttggtatggctgcggtatccaaactggccgccgttttatttgcgtctgcgcttggcggcgtaattggcgtcaatcggagaaaaaaattccgatgaagcaggatatgccgttccaaaagatgattgaaatattgtccgaattgtggtatgataaatatggaatcaggttcattggagttcacaggtgtaaaaacctgtcggaaaagttttttgcagaaacctgatattaactctgaagcgagggaacgaaaatgaaacacgtgaaaacgatcaacagcgcaaatttaaaggagtccgccgttaagggcggctgcggcgaatgccaggcttcttgtcagtcagcatgcaaaacgtcttgcacagttgcaaatcagaaatgtgaaaacaaaggccggtaaaattgttggtttaacatgtttggggcagtcgttcgactgccctgaattttcgtataaggagaattgcatgatacataaatatcaattaaacggatacaacattgtccttgacgtgaacagcggagctgttcatgtggtggacgagctgttttatgcgcttctggatttctgcggaaatggggaagctgtgccgatgcattgtcccaaagaagccgtagaatgcctttccaattgctggacgcctgaagaaattgaagaaacctatgcggagattactgcgctgcgtcaagctgatcagttgttttcaacagatgattacggccggtttgccaaaatgatgacacctgcgccggtcaaagcaatgtgtctgcatattgcgcatgactgtaatcttcgttgtaagtattgttttgctgatacaggcgaatatatggggcatcgtgagctgatgtcccctgaaaccggccgggcagcgatcgattatctaatcgatcattcagccggtcgccataaccttgaggtggatttattcggcggtgaacctctgatgaattttgagacagttcgcgaggtagttcgctatgcccgatccctggaaaaaaagcatggaaagttatttcgctttacgatcacgacaaacggtattttgctcgatgatgataaaattgatttcatcaatcaggagatgtcaaacgttgttttgtcgattgatgggcggcgtgaagtcaacgaccgtgtgcgctcccgtgcagatggaacaggcagctatgacaggatcgtcccaaactttcagaaactggtgagattgcgtaaacaaggaccatatgaccagtattatgcacgtggaacattcaccaaatataacaaggattttgccgaggatgtgcttcatttaagtggacttgggtttgatcaggtatctgtcgagccagtcgtttccgatcccacaatgccttatgcgttgactgaggaagatcttcccgagcttgaaagggaatacgagcgtctcgctaaaatcatgatcgaccgtgccggaacgccggaggattttaatttcttccattttatgcttgatctcgatcaaggaccctgtgccatcaaacggctgcgtggctgtggctgcggcaatgagtacatcgcagtgacgccatccggcgaggtctacccatgtcatcagtttgtcgggcacgaggactggaggatgggcagcgtttacgatggttcgctcaatcaggaaatgaaaaaacgttttgcagccgcgacagtttatggtaaggaggattgccgtgaatgttgggcgaaattttattgttcaggcggctgcaacgcgaacagtatgcagtatagcggcgacattctcaaacctcataaactttcctgtgctttggagaagaaacgccttgaatgtgctattatgatcaaagcggcgcttgctgattcgcgttaattaaaagattaaacgaaaggccgcatgtaaagttataaactttacatgcggccttttttcatgcgtcagcataaatcatattcgtccagcataaattttctataaaaggtcttatgaaaggacgattaatatgggattcagcgcagcggatttggacaagattatacaacagcaaaaaaacgtgcggggaatcgatgaggcgaaaaataaagaaggagcgcagcagccagtctggaatcggaatggtgcatttttacgggaagaaccaatgggaaatgaaactggcgctgtaatgattcctatgcgttccttcgtagccaatacacgaaatcgcgtcgttgtctatttgctcggtgttttgtttctattcggcatggtggctggcaccttaatggttcggcatgccagcacagatacactcgaaaaattaagtatcctgcttggaagttacgtagaacagcggcgaacccttgcatttgcagggattgtaggttcgacttttttctcaatttttacaatgctggcgattttgtttttctgtggcttttgcacgatcgcacaagtcgtaatatttgcagttcctgtttttaaaggacttggctacggtttttcaatcggtatgctctatgcagaatccggagcaaatgcaatttggtatgtattgattttgatgctgcctatcatgtttttaggaacggtactactgatcgccgccggccgttcagccttagctctttctgtaacgcttttaaggtcttcgattacggcttcaattccagccgatccatttcgaatcagacgttattgtataaagtttattatctttacagtgttttgccttttaatatcgatactggatgccatcctttcaacaaaattgggaagcctgagcttattcattttctgaatttgacgctgtaggactccgtctcttttttcgcggtgcaacgctcgacaacggtgagctttgcgccgctttttccatttgacgatcggatatatgcgtataaatctcggtggttgatagactggcgtgacctaaaatctcctttaatacacggatatctacaccaccatgctgatacatcaacgtcgcagcggtatgacgcaacttatgcggcgaatacccttggccggccaatccagcctgttcaaggcagcgagcgataatttgttcaacgcggcgaggagaaatgcgcgttccacgtgatgaaaggaacagggcgtctcgatatttgatatttgccggtgtcatgcggacggctaaataggctgttaaagctcttttacaggcatcgttgatatagacaatgcgttctttgtttcccttaccaagcagccgtatcgtgtcaccccggatgtcctgcaaattgatgccaaccaattcagaaagacgcataccacaattaagaaataaagtagccatgcaaaaatcgcgctcatagcttgaagattcaatatgtgtcagtagctccaggcattcttcaagcgtcaaatatcttggtacagatttcttaacggaaggcacctcaagattttcgatgggatttatttttaaaagcccagatttaaccgtcaggtaattaaagaacgatcgcagcgatgaaaccttgcgggaacgcgttttggcattgttttcacgttcggaggcagcgtaattgagatattgatagacatccccgagcttgatcgaagaaattgtctcaaggggaatatctgcaatggacacttgagaaaatgcgtcgatatcgtcagggtcggccacataatgctttacgcatttgatatagcgtaaaaatgtacgcaaatcaatatagtaagcatcaacagtcctttttgaacggcctttgatcgtcagcatataaaacagaaattcgcttaaatatgatgggcaatccgcataatcggccatagtaatcttcctccttttgcttcccttaatttcgctaaattttaatttaacgaaattgatgatttttattttacagcttccctttctgaatgtcaatacctattttctaaaggaatccccgccgtgcggcggggattccttttatgctttaatctgttcgcagtgcatctaccggacgcatgcgcgccgcgacggtcgctggatatacgccaaatatcattccaatgccaacggtcaatattatagaaatcgcgatcagccgcggatcaacggaaaccgggatatgcagcagcatgcacccgaaccataccacgaaaagtccagcgccgacaccaaccatactgccaatcagagagatcgtgaatgcttcaattaggaattccaatagaatggttcctcgtgtcgcaccgagcgattttttgataccgatttcacgtgtccgctcattgactgacacagtcataacagtcatgattcccaggcccgctacgactagagatacagccgcaatcgatgatagcacgattgtaacaattccgagtaaattattcaatgtatctttttgtttcgatatattttctgctttaaatcctctgttaatattatggagcctattcacggaagccgttaattgttctgcgacagcgtctgagttgctgtcatcatgcaaggttactgcaatctgctcaaaggcctgatcgccggtatatctttgaatggtagtataaggcacatatgcaaatgaagggatcacatcccccaccattgtttgcaggatatttccgcctgaggctgcaacgccgacgatttcgaggcgcacatagcttccgccaatcatcgcatccagatattttccaacaatattgtcgcgtttataaaacatttgcgcaacgtttgcatcaataacacagacatcggatgcgccagcgatgtccgcctcattcaacaggcggccatgctgcggtttcaaagaaatcaactgatcgccttcacaatcaactccccaaagcatggcgtttgcaaccaagccgcgcatacggatgctgctgaaatcgacaaccaccggtgtggcgcttttaacagttggaagattacggatcagttccaaatcgcgctgatccatcttttgcctcgtaaatttctgatccgcgctcactgtcagactgcccaaaccgagggaattaagctcatcagaaattgtctgtttaccaatttctccaatggagccaatcagaacaaccgaggccactccaatcgcaatgcttgcaattgtcagaaagcttcgaaatcgtttccggccaagattgcgcaggctgcaaacaaaactatcgaacagcatgacgtgtcactccttcctcaaattgatgagtccgccttctgttcccgccgctgccacatccgacagcaagatatcatttggtgaaagtccctcgaccacttcgacgccctctaaaagttccataccagtcttaattgtcctgcgttcaacacgggcgccgtctgcaacatacacatattcctcattgttttcgtcctgccccacagcttcatatggaactgtcaacattgtgcggcgcgtatctgtcataatctgtgcgcgcactgtaaagccagctttcagatggtcgtctgggtcatcgatggaaatttcgatatctacaactgtttcctgcgcggttgtacctgtttgcttgcgtgcaacaggatatatacggctgacatgtccatgatatgttttgtccggaaacccggtcccttcaatgatcgcctcatcccctaccttgatatcagaaacatacgactcccctactgttaccattgccacaaagctgccagtatctgatatggtaattaccggctttgcagtgcgcgacagcataccgcttttaatttcgatatctgtaacaattccatcgattggcgcggtgatcacatcaggaacataaatataggtattggcctcattcactgcgctgtcaagcgcggagtaagcctgcgccaaatcatccagcgggccaagctcggcgtccaatccagatgccttcaaagcggaatacattccaagtaaatcggacgtatccgccggcagagcctcagtaataccggaaagcagaatcgaggcaggcacgctttgctgcatgatgcttcgcgtcgtctccgtatcaataacggcaagcacatcatctcgggcaacacggtcccctactgatacgttgactgtctgtgccattaccggcgtatcaagatagatttcccgaacattttgggcctcaatggtccccgaggcgctgatccgcttttcatataatgtttcatttggcgtaatacaggaaacggtcggcaccgcacgcaatacaatcaacggggcagccgcagccaccccaaaggaaccggctgccaaaagcagcgcggcgacacgttttaacaacaaaaataaaacccccataacggcgatgccagagacttatctgaaaacagtgaatacgtcggctttttcacaagcagcgcccaatccgctgcttgtgaaaaatgaccaattttcagacaaatccctgatcccggaaataaccgaggttagtgtttgccgttacagggattttatgcgaactttgagaactggaatccaccagctctcaaccgtatgaatcaatgcaaactggttaatataatgcctgcatttgaaatttgcaaagtccggtgtatgagatacgtccgggcagcgggagggtatgtgtcatggcaaaagaacgaaaaatacgtctcattccctgcgacaaagattgctattatcagcagcagggctactgttcccttgatgaaatcggctacattaccaattgcgaaggcaatggctgcggctattttacacgcaccgacccttatgcagatctatcggatgaccgcgatcgcctgtgacagattttgcacgccaatcagatttaaatccggcatatcgcgcgcgtcgaccattgaaacacagtggcgagggatcacacaggtcgtaaaaccaagccggtatgcctcgctgacacgctgttgaatactgccaacagagcgcacctctccggccaatccaatttcaccaaaggccgccagatcatctggaatgcatttatccagcagatttgatacaagcgccattgcaaccggcagatcagcggccggttcatccagccgcagaccgccgactacattgatataggcgtcgagcgtgccaaaaaaataacctccgcgcttttccagcactgcaatcaacagcgccgcgcggttataatcaaagccggccgcttgacggcgcggcgtaccaaagcctgtcttggagacaagcgcctgaacctccgcaagaattggacgcgtcccctccatgacacaagccacacatgttccggagacgtttttcggacggcctgaaagcatcatcaaggaaggattcggtacctcgcgcagaccttcctgtcccatttcaaatacaccgatttcattggtggaaccatagcggttcttgaccgcccgcaaaattcggtaattttgatggcgttcaccttcaaaataaaggacggcgtcgaccatgtgttcaagcatctttggcccagcgatcgcgccgtccttgttgacatggccaacgataaacactggaatctctgcgctctttgcaattccgatcaaaacttgcgtacattcgcgaatctgagtaacactgccggccgatgaagttaacgcagtaagattcatcgtttgaatggaatcgatcatcacaacatccggcgacagctttcgaactgtttccaaaacattttcgacatctgtcgtagctgaaatataaagattgtcgctttccactccgagccggtttgcacgcagcttgagttgccgcgcgctttcctcgcccgatacatatagaattttcagaccaccgcagagatactgacagatttgcagcagaagcgttgatttaccaatcccaggatctccagaaagcagcatcactgagccggcgacgatcccaccgccaagcacacggtcaagctccccgacccctgtcttatatcgctggctatcatcggatgatatgtcagacagacgcgccgcctgtgctgcggcacgcggtacggagggagctgctgaagccgcacgcgtttttgacgctgcaacctgctgccgcacctcctcgaccagtgaattccattcgccgcagtccggacagcgtccgtaccattttacactttcatagccgcagctctgacagacatatacacttttgttttttgtaacagccatttgttcccattccttcatatttacattaccttttactttatgatggaatggctattctgtcaagcccttacaaggtacgcgctgcctggcggaataatccttaaaaaatgaacttttgtacccctgctttttcatttatgcgccaggggcataaatatcccgattgtccgcataaattggagcggggggatgcatatgaaagtccaaaaatctacagccgcggcggttattttacttatgctgacggcgtttgcgctggctcgctattccattcggtctattactgcagtttcgccatcattcgaggcttttgaagcaccgccgactatcattattgatgcgggtcatggcggctttgatggcggagccgttggcgtagatgggattgtggaaaaggacatcaatctttcaatcgcattaaagctctatgatttgtttacaatcaatggatacgatgctattctgacgcgtgacagagatatcgcacttaacgatgagacagcaaccacaacacggcaaaagaaaaattctgatattcacaatcgatttgatctgatgaaaacatatgataactgtattttcatcagtatccatcaaaataaatttacacagtcaaaatactttggcgcacaggtcttttacggccctaaaaatcctgaaagtcagcttttaggagagattatgcaggctaatttaattgaaatgcttcaaccggaaaatacacgtaaaagcaagccgtgtacagatagcgtatacctgatttataatgcgccagttccagcgcttttggttgagtgcggttttttatcaaatccggatgacgcatataagttggttaatgcggattatcagaagcggatagcgtttgcagtatttacaggtgtgtctgaataccttaattccccagggcgtacagaacaacctgaaggcacaaagcaggtcgtatgggaatttgatccgcgctcggccatggcataaaagcctcatgcgctgtgggcgtacgcgatcacaggcaaaatttgcagcgataggacgcatagtacgatataaaaaaatcagttgccaaagcaactgatttttttcaggcagcgcaggcacagcccgcgcatcgtctcgccataatgcggttattttgctattcttacaacagattggctccgctctccggatcaaatagatggatcagatcctcgcggaaggtgaacagaatttctgtgccatatcccataccgccgcgatgctgctcggctagatctgtggtggggatgcgcaataccacatccttgccattggcatccacatggagatgaatctcgctgcccatcatttcagacacgtcaaccttggaggaaattgtatgcgttccagccgtttcctccaggtggatatgttcggggcgaattccaagcttgacagcttgggatggtatacttttagccgccagagcactctgaatctttttggacaagggcataactgccccttggacttcgacctgatagccgctttccgtcttaataagctttgcatcaaaaaggttcatctgaggagacccgatgaaaccagccacaaaaatgttgatagggtgttcaaaaacctcctgcggcgtgccgatctgttggataaagccatccttcatgatgacaatacggtcacccaaggtcatggcttcggtttgatcgtgggtaacatatatgaaggttgtatcgatacgctggcgcagcttaataatttcagcgcgcatctggttacgcagcttggcgtccagatttgacaggggttcatccattaaaaacacctgaggatttcgcacaatggcgcggccgatggcaacacgttggcgctgtccgccggaaagagcttttggtttgcgctccagatagctggtgatatccagaatttcggcggcctcccgcacctttctgtcaatctcatccttgggagtcttacgaagctgtagggaaaaagccatattttcgtatacagtcatatgaggataaagagcataattttggaaaaccatggcgatgtcgcgatcctttggttcaacatcattcattcgcttgtcgccaatcaggagatctccctcgctgatctcctctaatcctgcaatcatgcgcaaggttgtggatttcccacaaccggatggtccgaccagtacaataaactccttatccgcgatttccagattaaaatcgtggacagccgtcaccttgttgtcgtaaattttctttacatttttaagagtcacagttgccatgtatacaagccgtggggctgcctgcctccgcaagcgccccttatccgcgcagagcgaacctgcacggacattacgacaggtctccacactgccgcaccgccggcccgacggaatttgcttcctccttttttatggcttacacgcccctataaagtaggagtagagacatgcagcctattttgagatgtacagggacttatgcagtcggtcagcagagaaaatgtttaacaatacttggatattgcagcttcaatcatagcgtttgcagcctcgacgatagcggtatcctcttggttcatggaaggcaagggcttgcggatgccgccacagtccacaccgtgctttcttagaatagctttcaccacatcatacatgttgccgtgggccgcgcacattttatagataattcggcaaatgtcattttgtatcgcgaaagccccggcggggtttcctgcacagaaaagctcacgagccttgatgaacagctccggcataacggcataggtgccgccgataccgccggtagctcccatggccaggccggaaataaattgctcatccgggccgttcatgaccacaaaatcttctccgccctgatccttccacatttggatatcctgggtaggcatggaagaattctttacaccgattacgcggggatttttctgcatctcggccaacagcgaggatgtaagggccacgcccgctaactgcgggatattgtagatgatgaagcctgtgtttggagccgcggcggaaatatcgttccaatactgcgcaatgccatatgggggcagatggaagtagatgggaggaatggccgcgatcgcgtccacgcccagactttcggcatgtttggccagctcctgggaatcagcagtgttgttgcaggccacatgggcaataatcgtaagcttgccgcccacctccgccatgacattttccagcacagcctttcgctcgcaaacgctttgataaatacattctccggaggaaccgcccacgtaaagaccctttacattcttttcaagcagatggcgggccagcgcccggacccgttcgggcgagatatttcccgcatcgtcgtagcaggcgtagaacgcgggaataaccccttggaatttttcaatttttgacattgcgcttcgctccttatggcggcaaaacggctgcgctaagcagccgcgccgcattaaattcagcctttaacggcgcccatagtaattccctgggtaaagtatttttggaataccaaaaatacaatgataattggaattgcggccaaggccgcgccagccataagcattcccatatctaccgaggtttcggcctggagcgtggcaatgcccaatgaaatggtgaaattgctgccgctgcttaacatgatgagctgcataaagtaatcattccaggagttaataaaagtaaaaatagccaacgcgccgatacccggctttatcatggggacgacaatggtggtaaaggtgcgcagctcactggaaccatccacccgggccgcttccagaatttcgccgggaatactctcagaaaattgcttcatcaaaaatacaccgaagggccagcccactgtgggaaagataacggcccaaagtgtgtcatacagatgcaggtcggacatctcgcgcagcagcggaatcagaatgacctgctttggcaaagccatggcacagacaatcaggccaaagaggatggccctgccgcgaaaccgctttttagccaaagcgtaacccgccatagcagcggtaatgcacgtaaggatcatagccgccaccgccataaacacggtgttaataagccatctgaaagctgcgggcacggtgggaccctggagcccgaatatctcaaagagaggcgcagaacgcctgttgaacaggttttcaaagttggtgcttacccattctgaaggagcccaaacgggcttggttgcgtaaatatcggtggctggcttgaatgcaccggtgacgatccagtagagaggaaaaaggaacaggatcgccaagatcactaaaatgacgatagaaagaaccttataagccttattttgtccgctgatagttttcattctctccacctcctacttttctttcgccagccggaactgtacggcggatagaatggcgatgaaaacggccagcatgacgcccatagcattggcgtatccaaagtggccggactgttcggtcagcttaaacgcggtataataaatataatacatgaccgtgttcgtgccggaaccgccctgtgtcaacaactgaataagcgcaaagcactggaaagaattgatggtggtgataacgagtatgtacagggtggtcggcatcatctgcggccacttgatccgccagaacacctgtaaatcagtggctccgtccacccgggacgcttctaccagggagtgatccacattccccagggcggaaacatagaggacgatgggctgacctacagaggtggtaaacaggatgaggatgatgcaccacagagcaaagcgggaatcacccaaaaagttgatgttcttatcgatcagccctgtccctttcagaacggcgttgaatataccggtataattatcgtacatccatttccagaccactgtaacagctaccgaaccagtaacaacgggcagatagaagatacaacggaaagcggagagcacaggtcccttaagcttataaatggccgaagccacccacagggagaaagcgcatacggtcggtacgctgactacaacgatgataaaggtatttttcagcgcctcaaggaaggttttatcctgccaaagatttacaaaatttgtaagaccgatgaagtgtaccgcgctgtcacgcatattggcgtcggtgagactgttgaagatgcagataaacatggggatgatgacaaaacccacaaagaaaacgaggctgggcagcataaacaggtaaccgttgatattctcccgccgctgcagcgcccgtcccatagcgggctggttttgttttgccaagcttgagcacccctctcttgtctttgaattctttgaatatggagacgccccttccccgctgtgcacgggaaaggggcgcacaaattcccctcacacgtcagtgctttacggggtgatcattttgcggctgcattggcctctgctgcatagctggcgactgtggaggcaatgtcagcgccctcgcctactttctggagcatgttccaccaggaggtgcgcgcctgcgcccatccgctggtgacctgatagtaatcccccaggtaaggcatcagaacctgatactcatccataatctcgttgtcggcccagatcgtggacagatcgacgccgccggcagcggaacggacagggaaataatttgcagttttcacagcatccacagtatgctcggaattagccatgtagttgatgaaggtcttggccgcctcgatgcgggcgggatcgccgttatcgaagataccgaagccccaaataccgccctgaagggcaggttcgccgctctcggaagggaatcccataaaagcgatttgctcgccggtgatcgtcttttctgcgccggtaccggccgtgttgggatcgagctgctgcgcaatattccagcagaaagccatcttcagcacgccctgatagaacttggtgatttcgtcgccgcctgccaaagaagcgtcgaaagcgataccctccatactcttgagctgttcaagagccttgatattcagggggtcgtcccaggtatactgggtgtgctcggcattggtgaatgtgccgccgtaaagattgttgacaagtgcgcgcgtaccctggtcgccgccctgaccggcgcagtagacggctcccaccgtctcaccgtagtgagcatacaaagcctcgacagcgttgataaagtcctcagtggtccaggtgtgcgtctccagatccagatactggtcggccccggccgccttgaacgcgtccacgttgacagccatgcagtgggcggtcataaccagcggatattcatacacagcgccgtcgggagcggtgcaggcagtcaggacggattcctgaatttccgcgcggtcctgatcggtcagcatgtcagacagatccaccatgtacccgctggctccccagttggccacaagacgctccgggccttccattacaagatcgggcgcattgttggcggtgatggcggaattgaccttatcatcgccgtcggcataagccagatactccacctggaccgaaattccggtgtcggcctcgaaggcatcggtgagcgccttgacggcgtcctctttcccccagtttccaatgggataagtccacaaagtgatctcttgggccgcgcccgcagtatcgccttgagccggggcttgggcctgagaggactgcgttcccgcgggttgagacgcagcagcctgcggctccccgttcccaccgccggagcaggcagccaaagagaacaccatggcggcgcttagcccaaatgctaggacttttttcatcttcatatgacggttcctcctcaatttttataaatctaacagtatccctttcggattaactggttaaattgtataattgtttcccaattttgtcaatacatgtatggaaaaatttttttattttgtaagaaatgaaaaaatttctttctaaattttgttataaacgtctcttttccaagcggaaacaactgatttcagtaaagcttattgagtacggaagcggctgttttctcgttattcggtccgcatcgatccatattgcgtcggtagtattcagtatacaacagatccaccaaaaatgcctggctgatatcggcactggctgaaccgctttgtaacggcccctcatttgccccacacagcagaattacatctgtgaattcagtcaggggcgacttttggaaacgggtgattgccacgactttagccccattttttttggccagctcggccacagcattggtatctttggtagaaccggagtaggaaaacaccacagctacatcctccgcagacatggtagcggccagcatcgcctgggtatgagcgtcgtttacacaattcaccttcggttcaatgcgtaagaatttatgggaggtctttaaagcggcggtaaaagaggcgcccacgccgaaaaagataatacgccgcgcctgactgagataatctacagcccggtccagctcttttacatccagaagggccgccgtttcgctgagagcgcgctgttcggtttgaagcaccttctgcaccaacgcattcagatcatcccacggagttatggcgcctgtaagaacgtcctctttccccacatcggtctgcatgctcaggctgaagcgcatcttgaactcctggtagccgcccattcccatcgtgcggcagaagcggaacacactggtttctccaacgccgcaggcgtcggacagttccgtgatggacataaaaatgacctcgccgggatgttccatgatataatcggccacttttttttccacgcgggtaaattggttgtagacggagcgtattcttgccagaaaatctcccgtctcgctgctgacaatcacggcgccgccccctttcctcctgttttgttaaagacgttcagcaagactataggccccataaagccccgccatattgccaagctttgcaccgacaacctttacaccccggaatcccgggataaggcgctcataaaccctctgagccgccccctcgatggcgtaaggctgctccataacgccgccgcccaacactgcacacggcacattgtaggcatggatcagcgtgcagaggccggcggccacctgatccagccaagcatccaccaccgcctttaccgcaggttcgcccaatctctggaagatatcccggccggtaagaccggggacaatcggttccatagctgcacacagggcggtggtggatgcgcaccgctcataggttccggcaaatggatcggccggatcgaacagctctggatgaagaacgagtccccccagcattactccggcggatgcacctgcgccgtaatagagcctgccgtccagcacgaccccgccgccgatgccggtgccgtaggtaaggcagagataatcctgttctccctgggccgctccattgcgaccctctcctaaagcggcggcatatacatcattgatcactgccgcgggtacgccgaaacggttttcgaaaaatcctttcacatccgttcctgtatagccggggacgttgtcgtttgcgtaacggatggttccattctttggatcaacctgccccgcagtgctgataccaacagcctcaaaaggccgaaaactttccagaagcgcggacgcctgtttcaacagatggaaggccccttgctttgcctgtgaatcggtttcccccttctgatcgggctttccggctataaaaacacatcctttaattttcgtgccgccaatatccaggacggctacgcgccgcccgctcatggctccagggcggccacgaaccgcttggtaatctccatggggcgagtgattgcagaaccaactacaactgtaagtacaccgatatccatggcgtggcgcagatgctccggcgtgatgatatttccttcggccacaacgggcctgccacactcatgcaccagtgttttaatcatatcgaatggcggcagacggcggccggcggtatagggggtgtaaccagccatcgttgtgccgatcagatcaaatcccatgccggcagcagccatcccctcctccacacttgaacagtcggccatgaaaagctgttcgggatacctctcccgcacctcgcggaaaaaatccgctaaagcgcggttgcccggacgggtccgtttggtggcgtccagagcgatcacttccaccccgcatgccgccaaggcgtccacctctgtcatagtaggcgtgatatatacgtcggggtggtcatcgtaaacctttttgataatgccgatgataggcagatccacattctttcggatctcctcgatatcctccaccgtattggcacggataccggccgcaccgccccaggcagccgccaacgccatgcgtcccatgatgaaggaactgtggagaggttcctcgggcagtgcctggcaagatacaatcaatttacctcttacctgttcaaaaaacgccttgttatccattactcccatttcagacacctcacaacaatcattttttgtaactttttacctatcataagcataccactgaaaaaaatatttttcaaggtttaatttaataaaaatctcttttttatcttgctcccatccctttcctgtgctatattgaatacacattatgaaaaggatgtggagccaatgaagccgcatattatctgcttgggcgactcaaatacccacggctactgcgcagaccccgctgattgcgcagacggcaatctcctgcgcttcaatgaggaggagcgttggacccaacttctccaaaaggcgctcggagcaaacgtcttggtttttgaggagggcctctccgggcgaaccactgtcttttcagatcccctttatgagggcctgtccgctttggactacctctacccctgtctcaaaagtcacgagccggtagcattgcttatcattatgctgggaacaaacgataccaaggagcgtttcggcgccagtgcagcctgtatcgacctggggatgcagcggttgatccgcaaggcgatgacggtggattgctggggacactgcaaaaagcccaatatcttggtggtggctcctccccccatcgacgaccggatggaaaattccagtgtagggtccactatgggccgcggctgcggcgaaaagtccaggcagctcccctccctttacgccgcctcagctaaattactgggcgtccattttctggatgcagcaggctgcgaattcaaccagatagactatatgcacctcacccgccggggtcatgcccaactggcccatcgtctaacggaatttgttccgcatcttttatagcttcaagtaaagaagccgcaaacaaaaggattctgtttgcggcttcagccacgttttcaagctatttaagataccagggcttatcttcgttttcctggaaagaatccgtgcaggtacattttttcagaacccgctctactggaaaagaagcgagcagggccgtcactgccggcgtgacggcaaaaagcaggaaaaaccacagggctgttgtcagcgtaacggataagaaaataagcagagccagcgcgatcgaaacgggcagataacggaatgtgagcagaaacgcgttccacagaaggccgccaagactggactcgaaccgtgaaagcagcgggagcagccagcataggaaccctattggcaacaacagcagaagcgtcatagcaatatagctccccatcagcaccttatcaccgcccgaagccaacgttcgcagcattccatgttcccaatatagaaaaatacctgccggaagacagagcagcgtcagcaggctgcccattttccagttggtctgaaaggaccgccaaaaattgcggtatggatgcttctcgtctctgcgtacacacttgaccacactgtagtagagggcggctgtcgccgggccaatcgttattaccggcaggcaggctatcagccagaccacgctcagacccacgatatccataaatttgctgatgctgctgaagaatccgttctccggattgaatatctgatggaacaacaggcgtcgcctctcttttttaattatgctgaaccatatttgcgaagcggctttgccgtttccactgcgcttattgtaccctatccttataaaaacgtcaatcagcctctttaagaaactgtattcacagccggaggatgcaagtgcgaaaaggcagcggacgcgaaagtgtccgctgccttttcgactttaaaaaacttgattagcggtaaataggcaaaaagcgggcggcgcgaaacgcgccgcccgctgtaggaaaacggatttatttgcgtgccagcggaccgtctgaaatgatgacatgtccgccattggaaacagtaaagtgcagatagccgttcgtatcgatgtagtacatcggattggcaatcggcgtatagacgtttgtcgcagcgtcatacgaatagaaatacagattctccgtattcatgttggtcagatcgagcttcacagcaacttcaatcgccatgccgaacgggccggtatgctcaaatttgacaatcctgatgttgttggagaaatacttgtcaaacagcgtggaaaccgaaggagcggacagttcaacgccaagcttgatatcgcctgtaagcgaagcgtactttgcaggatcgatatacatacgcgactgcacaacgccattcctgacgacatcggaccaaacgaccggagtgacattcacgccagtgccggccgctgcctgatcaaccgcatctttgaccgccttgagggcgtctgcgccgatggacgagccattgcggatgacaaccggggcgactgccgtgttggagccattggccaacgcatccttgatcgcattttctgccgattttccggcttccttacccgcagcggccggagataccgggacacgcgcgccgccggttgaaccggtcgaaacgctgcccttgttgttcagcttgctgccgccggaggaggaaccgccgccgccagaggagccgcctccggaagtcggctggctgttgatcacaatgaccgcctctccgtaaccaattccgagattggacggatcgccgctgtcaagattgccgctgtcaacgatcggacgtgcggaaacgtaaacgacataacttcccggggcaacgtcgccattggcaacaatcttatcgccgtcgacgccgaaactgccctccgaaccgctttcaaggttatacataacatctaggctgtacggaacattcttcgcttccatcgaagcgacaaccgtatccgcagcgatcgtgccggttaagcccgccaccggggtgacaacaacatggaacgaatcggggtcggccacgagcgtgacaacctggtttgccttatcggagctttggaaatcctcgtccgtgctctcgacataagcagaaatctgctttgtgagacggtggtcaggcgtatttgtatcgactgtgaaggaatcggaataaaccgtttccgcaccgccattaaccgtatacttgattgtgcccgcattgttcgggttggaaattgtaatgtccgcgctggtgtgattttcgttataagcaaccgcaatcaccggagcggcatacttgtcaacctcaggcacctcgaacgaaacggaattgtaatgataatcctcgctgttcttgatggtgacagtatatgtaccggcgtcaaggcgcttggcaaagtcgatggtgatcttgtcagcttcctgtttgaagccggcaatttcagcggccggcgcaacggacacatcggtctgcgcaacgaccggcatagaggcgctcggattttccaacgtcaatttgaggacgacctgcttcgaggtgctcgattcaactgcgacgttgaccttttcaccggtaagctcggtataatcctcgacgcttaacgtgacggccggcggcgtcgggaccggcgtgccatcggtgtaatacagcggatcgaagccaaggaggctgtaatacggattgccagaaccgatggccaagagattttccgtaaaatcgccgggcgtattgaccatgctttcatcgctgccgtcgttgttggtgacgtcgacaagataccaattgccatccaactcgacgtaattccacatgtggttgccagcgcctgtgccggaaccaatgtggccctctacgatcaggcagccgatgtcgctttcatcgcagagatacttaaacgccttggcatatccctcgcagacaacgggctttccgttaaaggcgttgatcatctggtaggtatcatcatagataccatcctcaagcgcggggaaatcataggtggtcagattgcagatggcttcgttgaaataacgaaccttctgataatcggtgccgctggcattcgccacaatctcggcagcttttgcaagcgcgctggcacggtctccgcccttattggagtcaatcttccaataggaataggaacccgacagtccattgtatgtatcctttttttccgaaccggggacgcgatagtcctcaataaccgggaaataggtatagacattcccgccgccagaaacataggagatattgtttcccggcccttttccgaaccaattgagcagctcggtatgatccatcaggttcgcttcaagagccgcttgaacatcggcgaatgtacctttcacagtatatttactgatacaatcgccgatgccattgtcgatattctcaaaataactgagcatatcattatagatcgtcttggcgttcccagtgagcttgttgccgtaaaagttaccggtcgccgcgtacatcgcgggccgttgggcgatctcgaccatcaggtcttcgacgtcgacggttacaacctcataaacaacatcgttgtttatgctgtcggccgccgcatcgtccgccgccgctgtgatggctgttccgaaaaccatacacaacgcaaggatggatgctagcactttcttcattactttttagattcctcctctttttcacagccggatacaaaaaatcgtaatgggtttcagcagcagtttttatccaagataccgctgccgaaccttccgctgtgcttgatactctattaaaaatgtctgcaaaccgacggcttgccgactatcagctccagctattaattagccggacgagccgcggaatgctcacatttttaatcagatcactctgtaaaggtaaaaggctttgcaattgttataagaaaattatcccatactttgcttactgaatttctcctcttttcccaaattatttaaatacattatagcagttacagtttttttgtcaatcttcagaaattttatgtatttataacaaacattatccgattttcaactatgtagtcaggttggaggaaggctgactcaggtcctctttttcacatttttgagaaaagatcaacgcgtttgcaacagcgattacataccgcttattttctggcgttaataaagtgaccagcttttgtatctcatttgtttcctcacatgactctgtaatcatccaaatatcctccttccaatttttcttgctacaatcattatataaagaatatatgatattgtcaagattttgtttgtttaaatatgctctttacaagcatttatagatgtgttatactcaaaataaaagaagttggtgaaagaatggagccatatgagcgaatcagatatctgagaaaaaagctcttaaaaatgactcttgaggatttctcaagtcgaatcaatatttcccgttctaatctaggcaatattgaaacaggaaaaattaatctaacagagcgggttttatccgatatctgccgggaatttcatgtcagcccaaattggatttccacgggtatcgagcctatttttgaaaaggactgcgatccattggatcttgaaatcgcaaagctgtattccattttaactgatgataacaaaaagtatctatttgggtatatccaacgactgattgaggagcagagccaggagtgatgttccctgcctgtataaaggaaaagcccctgaccatgccgccaatggggcggttcggtcagaggcttttgccgtatctttatttagtggccgcagtcggtcgcctcattgcggccgcgcttcgcctgggtggacttctggttcaggctgttgctcatggaattgcccgtgctgctgctgtaaccattcgaagcctcattggtcatgctgttctgcgaggaacggttctgcgctttattggtgcttttgctgtttttcgccatgtcctttcacctcttttcaaagtagcgtattgatagtatttggcgttccagataaaattattcttacctctctacgctttagcaggcgaaatatacggtcaaaaaagctttcttttcgatggattcaatcgtacttttccaacaaattttctataaaattgaaaaaaaacaagtaaatagcttgactaataatatacttccatggtatagttataaacaggcaagaaaaatgtttgctatttcatcgacaggaggaattttataatgaaaaagtttgtttgcacaatttgcggttatgttcatgagggcgatactccgccggagttctgcccgcagtgtaaggctcccgcttccaaatttgaggagcagaagaccgatggtctgacttgggctgacgagcatcgcatcggcgttgcggccggcgttgacgccgagatcatcgagggactgcgcatgaactttaccggcgagtgcactgaggttggtatgtatcttgcgatggcgcgtcaggcacaccgcgaaggctatccggaaatcggcctttattatgagaaggctgcttatgaggaggctgaacatgcggccaagtttgccgaactgcttggcgaggtcgtttatgctgataccaagaagaatctggagctgcgcgttgctgctgaaaatggggcctgcgaaggtaagaaaaagatcgcgacccgcgccaaagagcttggtctcgatgcaatccatgataccgttcatgagatggctaaggacgaagcccgccacggctgtggtttccagggcctgctgaaccgttatttcaagtaagcatcctcctgatattaaaaggtaaaagggtccgtccccactgtaatggggacggacccttttctgctgccttgcctgtaagaaaagcatcattttgcccgttcatatgtaaggaaatagcttgcagtctgagagggatcctgatttgggaaatcggtccgggtatgacagccccggctttcagttcgccgcaatgcagactggagcaccaactgagccagagtcacaagctgtattagacggcgttttttctgttgctgggaaaagcacggcgttggcagttctgatacatgtgcagtcataactccaagacgtaccaatccgctggacaacccttccccgtttcgcagaatgccgccgcaggtccataatatccgccggatctcctgttcctcagccataagaaaagcggacgcatcaggatccgcctgcgctccctggacgcagcgatccgcatctggccagtcgagcgtctgcgcgatcgatatctttttgctctcctcagcagccaaggcgccggctatctggccaaacacgagattttctgtcagggccgttgcgcccagacgattggcgccatggattccgccggtcacttcccctactgcatacagtcctggcacgccggttcggcagttgacatcgatcgccacgccgccgcaggaaaaatgagccgccggcgtcacttcaatcagactgtgagagggatcaatccctgcggcacgaagcgccttcactgcgccaaagctttgaagcagggccttttcagggatatgccgggcgtctacataaacgcctccggccggacttccgcgtccggccgcaacctctgttgctatcgcataggacagcacgtcccgggcagatacctccatcaaatccggcgcatagcgggccatgaagcgttccccgctccggttgagaagataagcgccctcccctcgcaaagtatcattgaccagctttcccttcaagctggcaggcgcggccaaagtagtaggcataaactggataaattccatatcgcgcaggcggcatccggattccagcgccataatatatccttccccggttacgcccgaagttgtagtagtgtgctcatagagagccgccataccgccggttgccagaattactgtcttagccgcgatcaccagtggacgtccttgttcatccatacctgctgcaccaacaacccgttccccggagcgcagcagctctgttatcagggtatccttgagcatggttatgccacaggcacttgcccggcgatacaaaacgccatacgtatcgcttccgcgtcctgaagcgcagcgaagggaacggggaaaggcgtgtcccccggatcggaaacggcggtattggccatcttcggtacgataaaattctacaccccatccggcagcccgttcaatggccggaatggcgccttctgccaggcggtgaagcagctctggctccaccaaacccgctccgctgcgttcagcatccgcaataaattgttccacagaatcaccaacagaatccttcagaaccactgcgtagcctcccgcagctaccgctgtggaatttcctcccgccttataaaccaatattaccgaagcgccagcctcccgcgccgccatggcgctgcacagtcctgcgctgccgcctcccaataccaaaacgtcaatttccatttttaccggcaccattgacagaaacgctccttatcattttatatcattcaatcctgtggggaatctataaatcaatttcgatttgatagcaatcatcaattaaaatatagggatgattgtgctctttacacattttaagataatcagcattttcttcaagcaaaaaatccatggtacaccatgtgtcatcgattcgctgttcaattacatttgcgtattttttaatatccgaaaaatgctgtttaatatagtccttgctcattactaaacaaaggtaacgaatttcgttgagatactcatcggaaaagtcctctttccaatcacttggaatataacagccctctactatgaggttctgccggttttcaattgcggtttttatcatttctcgaacaataggccacaaataggtttccaaatcctgatcgtcaacgggagttaaatttgtattgccgcttcggattagtcccattttcaaaagatctatcgacaaatatggatactgatatttattaagaagcgcctgcgccaacaatgttttacctgtatgcgaaccccctgtaatcagtacaaccatttcactccctcctttcaaattctgttgtctttgcagatttaaaataaatataacacatcagcaaaaacaaagtcactacatttttaaaatcttcgaattttaaaaacgcggcatagaatcatttattctatgccgcatcctgcgcgctgctttaaattatggttatggttgtggtgcagggctttgccatactttagggctgtcatgtttaccggattggacaatgtattctataatcttttcgcatggcagcgttgggatttcataattggccctgagcagatttaatccgaactcatgctcggccaaagtcgtagaatccaccccatcctcagcgatgataacctgatagccctggttgaatgcctcaataaccgtctgtgcaacacatacatgggtacgccatcctgccataataatggtatctgtcccaagcttattaagggtctgctggaggttcgtctgaaaaaaggcgttgaaatatccttttttcagaacataatcctgcggcttgggcgcaagctctttgacaatctccgctccccaagtcccttccatcgcatgttccttccaaatttccagctccgaatcgcccggatggtgggaatcacagacatatacgatcggaatattcgccgctctcccggcttcaaaaagccgggagagcggctggaggatgttgtaaaacctgcggcacggcagcgccccatcttccagaaaatcgttttggagatccacgccgacaatcgcggtatgatgttggccaatgccgtcgagcgcatccttttgataaggcgactgaccgcaggttgctactgtaatcgcgttattcagtcgaagcctgatatgctccagttcctggatttggttctcgattttatagagctgacgcttcaggataccgcgcagtctgctgcccggcgtctccaaaatctcggagatttcgtccagggaaaactgttgttcccgatataagcgtatttgctgaagccggaaaatgtcctcctttgagtagagacgataaccggaggaggaacatctggccggagcgatcaatccgactttttcataaaaccggatgcttttgattgtcagaccggtaatttccgccgctaccttgaccgttaccatttgctgctccatttgctccataatcgtccccctttccagacacgcctgactttccttaaagctattacaatttttcaataacctgatcgctggttgtcacagtgccaaaatgcgtttcaatatcccaaagcgtagactcctgctcgcgggaacctgtagcccggacacaatccttgggcacaatgacctgataaccaaggaagaacgcgtcatggcaggtggaacgcacacagatatttgtaaccacaccggtgacaatcacagttttaatccccaactcccgcaaaaccaaatccaaatcggtctgataaaagccgctgaaccggcgtttcggaatctgataatcttcaggtcggggcgccagttcatcgatgactgcggcgccccaggttccttcgatacagtgcggcgcacgcttctcgaactccttatcgtacttgtccgcccgatggcagtcattaatatagatgataggcaggcccttttcgcgcccctttgcaatcagcgccttgagcggctcaactgtctccatgccctctttcagaggcattttcccgccgtctttacagaaatcgttgagcatatcaacaatcaaaatcgctccgtgctccacggaaaaatcgcttccgtcatccacaaaatactccgaaaaacctttttcagccattataattgttctcccttttccttctgtttattatagaggcttactgcctctgcttgattccgctgcccattaccttgcctaaaatcgccttgaccaggaaggccacaatgatacaattgacgacaggcataccgatctggatgcgggaaacgacaaagccaacaatccaagcaataaaccctgagatgttgattgtgggaagttcaattttatccatctcaggatagtcctgacgataagtcaccaggaagtccgcaagaaaaataccgcccagagggggcacggtagcagacagaaaatcaatataactgccgaaatagttataaaaaccgataacggcaaagatgatgcccacaacaccgaacccaatgaccagataaggacgcttaatctttgtaacactgctcagagacatggaaccggaataaacgcagccctgagctgtggaccagatattgagcaccagcaccagaaatgccggcgccagcaatccctgcgcagccataaccatggcgatatccggagaaccggtggccaccgcgccgattgcgccggaaagaaccataaaggtattgccgagcatcaaagtaataatcatgacaatgattgcggtcttggcgcttttagcgaaacgcataatatcaggcgtgaacataaccgcgcctaccgcgtaggaaccaacacccaaagccaccgccttgctgaagctgattggattttcctgcgtcatggccatcagcccggcaacaccgccgctgctctggacagccattaccatagagattgtgccaaacacgataatcagaggcacagccaggttgctcagataagtcatccatttcattccacgcaatgccgtcagtgtcatgccgataccgcccagaatcgcaaccgggataatcggcaccatggaaaacagcgcattggtggattgcccgatcatatacgcgtcgatggaaaaccaaccgattgttgtgatcgccacaatggcgacgggtacatatgtacctgccttcccgaaggaatatttgctcaaaagtcccaatgtcagaccgctctttgccgcgattactcccattacacaagccagtaccgccaaaatgacactactgagcagaatagccagaaaagcgtcacggaaattcaggccaacgccgatattgccgcctgcctgcatactggtcactacaaagacataacccaatgagacagtcagaaggttcagccatcctttccgttctgacaatggcacccgctggttactgaattcatcattgttgttctcaacagggtttgcagccgatgaattttctttcattgatacatacacgctcctctcaatactgccctcaagccaaattcaaaaccgcccctttttatacgcctcctttcaaatggtcaggaagggggtccattcatatcctatcgctatggaacgccctgttttcaactgttagattacactatccccttaggggagagtcaagacttttttgtctgattgcatatttttttatataaataatcgattctattgtataatatcctctgatgtatttgttgagtatagcaaaatggcagatcgttttcagcataggcttttgatatactggaaaagcgccgcccggttgattccggacggcgctttgtagtcagaattcaggatgagccagcttaaacaattcatagatacgggctgtctcaccctttaaatagagatacccgaacaacgcttcgacaccggtcgcacgccggtaatctacaacggaagcattctttggtacgctcgcattcgcattgcggccgcgtttgtagacggcaagctcctcctctgtcaaaacaggctccataacggcaaaagcggccgactgcgccgatgcgtttacaagtgcgacggctcggtcgtgcatttcaccgacatgggccgttcccatggccgcgacggcctgccgcgcgcacagctcgtatacggcgtcgcccaaaaatgccagaggcagaggactgagcgcgcgcgggtcggctgtaaagggttccatcaattccatacagatttcctcacctgatatattcaaactcaaaattcaggatactgaccgtatcgccctcctggatacccatttcctcaagcttatcgatcacgccgctgctgcgcagcacacgctgaaagtattgcagactttcataatcgtccatatcgaccatcccaagcgccggcatcagccaatcggcttcgacgatataaacgccgtcctccacatgaatttcaaattgatttttcgcaagccgctcgcgctcactcagcggcacatgctcaatctcaaactgacggatcggcggaagcgtgtcaagtttttgcgaaacggcatagatcagcggctggattccttcgccggtcggcgcgcagatctcatacagcggatagccgctttccctggcaaaagcacggaaggcttcaagctgttcaggcgcggccaggtcgcacttattggccgcgatgatctgcggacgcaaggcaagctcgctgttaaaattttcaagctccgcgttgatcgtgcggaaatcctcaatcgggtcgcgcccttctgaaccggacacatcgacgacatgtacaatcagccggcaccgttccacatggcgcaaaaacgcgtgcccgaggccgaccccctcgctcgcgccttcgatcaggccggggatatccgccatgacaaacgattttccttcgtccacctttacaacgccgagcaccggcgacagcgttgtaaagtggtaatttgcaatctccggctttgcggcggagacaaccgacaggagcgtcgattttccaacattcggaaatccgaccagccccacgtccgcgagcagtttcagctccagttccacctcgtactcctcgcccggcagccccggctttgaaaagcgcgggcactgacgcgtcggcgttgcaaaatggctgttgccccacccgcctttgcctccgcgcgcaacgacaaccggcttgtcgccggaaagatcagccataacgcggccgctctgcgcctcgcggacgacagtccccctggggacacggataaccagatccggcgcatttttgccgctcattttttttgcggcgccgttcgcgccgttttccgcaaaaaaacggcgcttgtacttaaaatcgacgagcgttgacaggtttgtatcagctacaaacacaatgttgccgccgcgcccgccatcgcctccgtcggggccgcccgcggcaacatacttttcacgccggaacgcaaccgcaccattgccgccgctgccggctttaatcctgatttttactttatctacaaacatgcatgcctccaattctttcggcaaaaaggcaaaaatatgaaaaatcccgagtgttttccactcgggattttaaacggttcttactgaacagggacgatcgaaacctttttgcggtcgcgtcccatacgctcaaacttgacggtcccgtccgcaagcgcgaacagtgtatcgtcagagccgcgcccgacattgacgcccggatggatgtgtgtgccgcgctggcgaacgaggatattgccggccagaacaaactgaccgtcagcacgcttcgcgccaaggcgtttggattcggaatcgcgtccgtttttggtggagcctacgcccttcttatgtgccatctataaaacacctctgctttctttctcgatcgttgttaagccttgatcgactgaatctcgaccttggtatagggctgcctgtgacccatcttgcgggcggaacccttcttcggacgataggtgaaaacggtaatcttctttgatttaccatttttgacaaccttgccggtcacaaccgcgccgtcaacggtgggagcgccgacaacaacgccgtcatccttgccgacggcgagaacatgatcgaactgaacggtggaatcagcttcggcgtcaagcttttcaatgtaaacaacatcgccttcagatacgcgatactgcttaccgcctgtacaaatcactgcgtacatgctggtacctcatttcaaaagactcgctgtctccgggcggcgccgtttgggcacactttgggcctggaacatgcggcaaaaattattttaccatagctgacaagctctgtcaagagctgtgccgtgatttccctactttccggcggcagtaatcgtatttttcatcagcattgtgatggtcatcgggcctacgcctccgggtaccggcgtaatcgctccggccacctcgctgaccgaatcaaaatcgacgtccccgcagagcttcccgttttcatcgcggttcatgccgacgtcgatgacaacggcgccgggcttgaccatatccgcggtgacaaactttgcctttccaatcgcaacaataagaatatccgcgcggcgcgttacctccgacaagtcccttgtacgcgaatggcagattgtgaccgtgccgtgctcatgcagcaggagcatggccatcggcttgccgacgatgttgctgcggccgatcacaacgcattccttgcccttcacctcgacgcccgaagcatgtattaattccatgatgccggccggcgtgcatggaagaagcttgtaatcgccgatcataattttaccgacgttggccgcgctgaaggcgtcgacatccttatccggagagattgcttcaatgacagccttctcatcaagctgctttggaagcggaagctgcacaagaattccgtcgatatccggctttgtgttgagcttgcggatcaaagcaagcagttcgtcctgcgttgtttcagacggcagggcgtattcctccgaatagatgccaagctcctcgcacgcttttttcttattgcgcacgtacaccttcgacgcggggtcgtcccccacaatcacaacggccagccccggcgtgatgccgtcctcggccagcgccgcaacctctttcttcatctgcgcgcgcagctccgcgctgatggttttaccgtcaatcagctttgctttcatcctctgcgtcctccccctcggttgtttgttcggcatccgttttttcctttatggaatccgccgataattctttgccggccgcatcatccgtttccgccggcgcgccgggctttttatagaaagtaccgttcacaacggactgaccttcctcagtgtccacatagagcctgcgcgccttttcgccgctctgacgcttcatatccgcgcgaacgtagacaagaatcgctgcggctgcgatcgtcagcgccgccgccagcgcctgtgaaacgcgtatattgccccacatcaggctgtctgtgcgcagcccttcaatcaatgcgcgcccgaatccataccacgccgcataaatcagcgtaagctcgccgtcgaagcggcggcgctttgtatacagcgcaatgagtacaaaaccagcgagacaccaaacggattcataaaagaaggtgggatgcaccggaagcgacgggtcaaccgcaacgccctgggcggctaaaatgtccttatgcgcctccagatacgcagcgatcgacggtccggccattccccagggggccgtcgtattggaaccgaacgcctccacgttgaaaaaatttccccatcgtccaatcgcctgtccgagaatcacgcctccggcggccaggtcaataaacggcagcagcttcacacggcgcagcctgcacatgataatcacgacgatcagcccgccgatgatgccgccgtaaatggccagccctcccttccggatattaaaaatatcaagcgggttggccgcgtagttttcccaggtaaaggcgacgtaatagagacgcgcgcccacgacgccgccgatcacgccgccgatcacgacatccagcgcgcggtcggggtcgacgccaaaggtgcgcgcgcgcttgagtatatagccaattgccagcagaaacgcacatgcaatgatgattccataccagtaaatcggctgcccaaacagcgtaaacgccacccggttgaccgtaaaatcgccgattccaagccccgggaaggaaattgtctgtccaattttatccatgctgtccggcccccgtcctattcatcaaggggtcggacaatggaaagcgccgatttttcagggttgaatgcaatttgcaggcgttcattcatctgatcgggcgtcgcattcgccacaatatcgagcagcgcgtacatatcgtctatcccggcgaaatacaccgcggacatcagccctgcgaccgaagccgtccgcgtatacatgccgatgtaccggccgtaggttgcccggcggcacagctcgaacatctttttgtcgacgccttccctgcgcatccgcgcaacctcggctttgatttcatcggcaacgcgctcaggctcgcgcgattctccggaaaagatcgcgcacatatagtcgcgtccagccatgatctcactgccaaatgtgctgttgatgatacccgcgtcatacatccggcgataaagcggcgacgcgtcgcccgcgatgatctccgcgaggatttcatccagaatttgatttttcagattttcgcgcggattgcccccgcaccccttaaagccaaactggaacagcggcgcggcgacggcaaatttctgctccacaagcggcttgcagatgctctccggctcgtcgacatggcggcgctcgatctcgaccggtttttcgtccggtttgatcacacggtccgccacgcgcagcacggcgtcgatgtcaaaattaccggcgacacagagcaccatattgttcagattataaaacgtgcggtaacagcgatacagcagctggtcgtcaatttccgcaatcgattcgacggtccccgcgatgtcgatgcgcaccggatggttgtgatagagcgcctggagcagattgaactgaacgcgccattcgccgtcgtcgtcatacatgcggatttcctgtccgataatcccctgttccttctgaaccgattcctttgtaaaatatggccggcgtacaaaatcaagcaggatttcgagcgactcctcaaaccggtccgtacaggcgaacagatacgctgttttgtcaaacgacgtgtatgcattcgccgaagcgcccgtcttggcgtatttcgcaaatgcgtcgccgtcctcgttttcaaacattttgtgctccagaaaatgagcgattccctccggcacgtcgacaaacgcgtcgtcgtcctgcgttttgaagccggtatcaacagagccaacgttcgcggtgaacgtcgcgtaagcggtcgaatatcccggcatcgggcaaagcagcattgtaaggccgcttggatgtttgatctttaccatttcctgcccaagacgggccgatttgatgacggtgcgttccattactgcgccgcctcctttcccgtgaggaagtagactgtgtcaagcgtcacccgtttggccgcctcgatgatgtcgccgcgcgtcacttcgtcgagcagcgcgctttcatcatccggcgagagcgcagcgcccgccatgatctgcgtcaaataccactcctccgtcgcaccaagcgaatcgccgaccgccttgagcgacgtctgcatcagcatacgcgtcgcggtgatttcctcatcggtgaaatcgccgcggcggatgcattcaagctgattgagtatttcatcatacgctttttgcttattctgcttttcaacgccgctgtcaacaaacatcaggccggtcaaacggtcgaaccgagcggcgcagtaataacagaggctcaatttttcacgcacataggtgaacagacgtgaactcggcgtacccccaaacagcgcgaccatcatgcgcatcgcgccgaaagccctgcggtcggggattcctccagtacgaaaacccatcacaagcttcgactgcgcgacatccatttcgtccttcacctcgcgcacctgatcggcgcgcacggctgtcgaaacggtttcaatcggcgcgggcgtgcggcggataccagaaaacgcctctgcaaagatttttttcgcgatttcaggattgccgcagccgttaaaaaacagctcgatctgcgccgtttcaagcgcgcggcgataagcgtccgcagccgattttgccgtgatccgttcagcgtcctcgatatagccgtacttatcgacggcaatcgtctccccttcgcacatgattgatttgcagcgcgacagggcatagacgcgcttatcgttgatctggctttcaatcgtatcaatcagctgctgcttttcgatctcaatgtcatgcgcgtcaaatacgccgtttgcatcgacattcggatcaagcagaatgtcggtcagcaggcgggcgcacggctcgaccatcgcttccccgccaatcgtgaagcggtcatcgacgccataaatcgaaatctccaatacctgataaccgccgaatttggccacatcgcaggacagcgcagcaccgtacagctcgcataaacgctgattgagccgtgtaaaatccggacatgcccgacagcccttgcgcaggatgaacggcacgatggcgttgtccgttacagcggtgcggtcaagctttaaaaacaggtttgcagtgatgcggttgtgcttgaatttggagtctgtgacgctgctgaaatgcacgccgtcgcagagcttctcccgttggaattgattgttcatgcagtgttctccttagcgggcgcatatgcccgaaaatactcccttgtccacggtgggacggggcggtttgctgatcgcaaaggcagcgttatgaaaccggcggggcaaaactgcggcagacaggcccgcgcctcgctccggccgcctgcggcgttgctgtttgccctgcgcatattataccatgccgcttcgcaggcatggtataatcggccattggggcggcagcgggccgcgcccgcgtatcgccctggccataagacggtataataaccgctctgcggttattataccaccgcgcaagcggcgagccgttgggcacaaccccggtataataaccgctttgcggtcattataccatgtccgcgaagcggcatggtataattgcccatcaaaaggcggttgccgcgcaagcggcgagccgttgggcacaaccccggtataataaccgctttgcggttattataccatatcggcggataagttcaactgcttttttagtgtttttaaccaaagatcagcgattgacacagacggctaaagctttttaatccaaacggcagacgaaaaaacgctgaattaaccgccgcacccatctattgaattggattcattgacaggcctcccgatctgtgctatacttcctgcatgactgaatggggggaagtttatggggcgtactgttaagcagccggaggtccgtcggcaggagatcctggaggctgcgctggacctgttctgtgaaaaaggctatgagggcgcctctatggccgacctggcgcagcgccttggcatctcgcaggggctgtgctatcgctatttcccctccaagcaggccctgctcgattgtgctgtcgatcagtacgcccagcagcaggtgcgcatactctcccctgttttgtgcgacgggacaaaatcgctgcggcagcgcatgcttgaaatgcccgcacccgagcactacgaggcgggcggcttttacaacgccttccacagcgaaagcggacgccgtatgcatcaaattttgtccgtgcgcgtctgtgagctgcttacgccccttgtgcaaaagcaattggaacacgcaatcaaagcgggcgaaattgtctcaaacgatccggagtctgatgcttcgtttctgatctggggacagcttggtttgctgacccggtttgacctgcctggtggggagcgtttccgccgggtgcagcagtgggttgtcgcatggctcgacgcggccgcccccacatgctgatcctttacttgaatgccgtctgacggcgttctttttttctaaattaattgaataatatttattcattaaggaggcatcataatgcaaatctatcaaacagccctgatcactggtgcgaccagcggcatcggccgtgcctttgccggggcgctcgccgcgcagggcagcaatcttatcttaacgggccggcggcaagccctgcttgaacaaacagccgctgggctgcgcgcacagtacggcgtgcaggtgacggtactgccggcggagctttcggatgaacgggacatttgcaggattgaggcgctcatccgcgcaacacagctcgatctgctcgtcaacaacgcaggatttggcctgcggggatgtttccaggacggaccgctcgagccgtatctgcagatggaacgcgtacatatcggctgtaccgtccgcctgacgtatgccgcgcttgagcagatgtgtgcgcgcgacagcggcgcaatcatcaacgtcgcctcggacgccgcttacatgattgttccggcaaacgcattctactccggtacgaaagcgttcatcaagcaattttcagaggggctttatctggatctgcgcggacgcggcagtcatgtgcgcgtgcaggcgttgtgccccggtttgacacggacggattttcagctaaagatggggatgccgaagggcaaacaaagaaatcggggcgttatgcgctggcaggaaccggagaccgttgccgcacggtcgcttcgctgtctggaacgcggccggccggtttgccactgcggcggcgcgatgggtattgcggaaagggtgctctgcgtattcatgccgcgccgcttctactacccgctggctctgcgcttgtttcctgttccgccggccgcctgatctggaaattgcgctttccaggcatcctaactgtgacacagtcactgaacggcgtgcggatctccagtatactgaacccaacagatcatacagccggaggggattttaaatgggtaaaaaggtactgatcgtcggcggcgtggccggaggcgcaagcgcggcggcgcgcctgcgcaggctcgacgaaaacgccgagatcattttgtttgaacgcggcgagtatatttcttatgcaaactgcggcctgccttatcacgtgggaggcgccatccccaaacgtgaggcgctgcttttgcagacgccgcaggtgatgcgctcccggttcaatatcgatgttcgcgtctgttcggaggttgtctccatcgaccgcgaggcccggatggtcacggttgaaaaccgcgctgcgggcgagcgttatacggaaagctatgacacgctgattctttcaaccggatccgaaccgctgcgcccgcccatcccgggcattgacagcgaccgcatccgcacgctgtggaccgtacccgacaccgacgaaatcaaagcctttatcgcaaagcgcggcgtcaaatcggcggctgttgtgggcggcggtttcatcgggctggagatggccgaaaacctgcggcggcttggtctatcggtgacaatgatcgaaatgctcgatcaggtgatggcgccccttgattatgagatggcgcttatgctgcacaagcacctggagcagcagggcgtttctctccgcctgggcgacggcgtggacgcgttcgaacacacggacaaaaccgtcacggtccgcttaaaaagcggccgtactgtcactgccgatctggttatcctttccatcggcgtgcgtccgaacagcaagcttgccaaagacgcggggcttgagctgaacgcgcgcggcggcatcgtcaccgaccaatttctccgcaccagcgaccccgcaatctacgcggtgggcgacgcgatcgaggtacaggatttcatcagcggcgaacgtacgatgattccgctggctggccctgccaacaagcaggggcgcatcgccgctgacaacatcgcgggcgcacagcagagctatgacggcacgcaggggacctctgtggctaaaatctttgaacttacggcggccagcaccggcgcgaatgaaaagacgctgatccggcgcgggatgaaaaagggcgccgactatgaaagcatcctgattgtgcagaactcacatgccgcctattatcccggcgctgcgccgctcgttttaaagctgttgttctctatagacggcaaacggctgttcggcgcgcagattgtcgggaccgacggcgttgacaagcgcatcgacgtgcttgcggcggccattcgccttggcgcgggcgtttcggacctgacaaagctcgaactggcctatgcgccgccgtactcctccgcgaaggacccggtcaatatggctggttatgtggcggaaaaccttctgacaggcaaagcggcgttctcatcctgggacgcgctcgacaaaagggacggcgcggttgtgctcgatgtgcgcgagactatggaacgccaggcgttcgagcttccggactcggttcacatcccgctcgggcagcttcgtgaacgcatcggcgagcttgaccccgcgcggcgttacgtcatattgtgcgccgtcggcgtgcgcgcttacaacgcgtcgcgtatcctctcggcccatgggtttaaagacgtcctcgtctatcccggcggcacgcacttttaccgctccacccacttcccgcttttttgaaaaaaagctcggcaaaaaactttagtcggctgcgttccagcctttttgaaaaaaggcttcggcgaaaaactttactcggctgcgctccagcctttttgaaaaaaggcttcggcgaaaaactttactcggctgcgctccagcctttttgaaaaaaggcttcggcgaaaaactttactcggctgcgccgcgaacagtggggcaggtttagttaaacgctccccctccagacgtactggcgtgcgcccgatacgatcgcgccaaacagaggcggggataacataaggggagggtcgccggcccgccccttgtgaggcgcgaaaaggggcgctgccgcggcttgtccgcgcccggcgcttatagcgccggaaagccccgaatagccggccgggcaagcgcagcgcccggcggtgagcaatctgcgcacggattgcgcgcgccaaaaccccgctccttttccatgcggattttcgctgtgtaactccaataagtttttaatatgaaaggaacgatctgattatggcaaccgtcactgtaacttccaataactttgaagccgaagtcctgaacgcggaccgtccggtcctcgtggatttctgggcgccgtggtgcggcccatgccgcatggtatcccctgttctcgatacaattgccgaggaaacgccgtcggtcaaggtgtgcaaggtaaacgtcgacgagcagccagaactggcgcagaccttcaaggtcatgagcatcccgacgctcgcagccttccgggacggcaagctgaccggcacgtcggtcggcgtgcgttccaaggcgcagatcttacagatgctcggtgtataagggacgctgatatgggacaaagcgcaggcgggcgcggccaatggccgcgcccgcccgtactttatccttttccttacccttaaacgccgtcaaaggcgggaaacaccccgaaaagccgcgccgtcccctgaccgacagggatgttcatccgccttcctctccggaaaaagccagcgcgcgcagctttttgcggtcaagcaggcggatgctgccgcgcgaaagcgagacgatcccctccccgacaaaatacctgagcacgcgcgttacaacctcgcgggcactgcccatgcagcgtgcagcctgctcgtgcgtcaggcggatcacgtcgctgcccgccttggaaaattcatcccacaaaagaattgccagccgttgatccatgcgcatgaataaaagctgctgcatcgcccacatcacgtcggaaaaacgttccgccgccagcttatatgaaaagcactccgcataaatgctttgttcacaaagcgccgaaaaatatggcgcgccggtcaaaagcgcgtctgtgtcctcctcggcgtcgatatgcacatcaaatgtgatctctgagagcacgcacgacgcggacaggatacaaatttcccccgctcccagccggtagagcgtaatctcacgcccctcctgcgagagcatgtatgcgcgcagccgtccgcgcatgacgaacagcacgccgatgcattcggttcccgcgccgtgcaggcgcgcgccttttccataatggaccggcgcggtatgttccgccaggccggcctgttccctcgcgttcagccgttcccataccgggaacgaccgcgccagataccggtaaatctcctcctgttccatccgctacgcctccccgtacatttttcacccgcatagcccgccccggcaggacggcgcttttcttctattgtggcgcatttgcagcgggaaatcaagccctttttgacacagcctccgaacaccgctattttcactggatgccggctgtgctataatcaatacacgcaggaatatataaggaggtgcgccatggaattaaaggaatatttggagcttttaaatcgcggcgaaacgatagagccaggatcggaagcatatcattatatgcacgctgtgacccgggaaacgatgcagataaccgcccgcctcaatacaggctatcacacggcgcaggaaattcgtcaactgttctcacaaatcattggaaaagcggtcgacgacacattcattctttacccgcccttttatacaaactgcggcaaaaatatcaccgtcggcaaaaaggtctttatcaacatggggtgcacctttcaggatcagggtggcatcacaatcggcgatggtgtgctgatcggtcataatgcgatgctcgctaccatcaaccacgacgaggaccccaggcggcgcgctgccatgcatcccgcaccaattgtaatcggtaaaaacgtttggctgggcgcaaacgttactgttgttccaggcgttacaattggcgatggagcggttgttgctgccggcgcggttgtaacaagggatataccggctcaaacggttgcaggcggcgtgccggcccgatttattagaaaaattcggagcagcgcagccgattaaacagaactggagctggtacgcccaacgggcgccaccgcttgcgtacatggaataatatccgtcatatgccaattttatcggcggctgtgaaattggtctgttataaaaacaaaccgcagggccattgttcgtacagatgtatattacgcagagctgggcgatccggtttagaacgcgtcctgtaaacaaacggcccggacaattgtccgggccgtttgcttcgttcctattcggacctgccgacaaaaccgccgcatccaaaacatctgcacttgatttccaagtctatcacaaaattactcgtgaagctgcaaaaacttgccttcaggccctattcgctttcaatcctgcggaacaagtcgcgcgccgacagcttatttccgcgcgccaatcgcctccaatgcgcctgcgctgccagacggtatgcaaagcgcggaaaattgatagacaaaaaccgttcctcgccggacgcgccgtttttgacgcacgcggccaatacgtccaaaccttcccccaacgctttcttgggaccatgtccgggcgcaacgtttgcaagctccagcatcatcggtccggcgccgatgccaagacccatgccgcgctcaagcccggctcgcagccgccaatgctccatcatctccagcgcgcaggcagtctgccgcccttcataaaatccacagttgatcagcgtataaacacgcctgcccgggcatggccgctgcaaaagcagcggctccaacgcctgcaaatggcgcagcagatgcgccggcaggccgtccacataaagcgggaaggcaaataccaaagcgtcaaaatccgcaaacgtctctaaaatctgcggatccggtttttcgattccgagtctgaatttcgtacacgaacagccctccagttttggatacaaggcgtcaagcagcatcccggagacgctgcccgtccgcttggggctggcgttgatcagtgctgctttcattttgccggcgcctcctttatatcatcgggagcattgacaaagcagacctggcttaacctgcaatagaagttaacggccatagcctggacaaatttgcgtgctgtcgcgcgctgggcgtccgtcaggtcggtcccataaaaccaaaccgtcaaatccatcctgttttcatagcgcgcccgatgatgcatctcaccatttttaaaaacaaaataaggatgcacgtaagcgatactgcgatcaatcactgtctttacaaacggactgaacccgccataaacacactggcttacaataaacagcctgtcgcagcgtgaaagctgtgcgcccatatccgcatggccgtcccgaattacacaggtcccgggcgttttaatccagcagccgaaacagccgatacaagggcgcgcagatccatcgtccgcgatgacgcgcgctccggcgaacacttcgtcggccagcgctttcgccgccgctcccttcacatcatgaatcagcagatccatttcatttcccctttcattgatacatatgccgcataacggcccacatacagcagtatgaacagccgtgtcattttccaaacagctccgccgcgcttttcatattttctataatcggcacgccaaacggacagcgtttttcgcaggcgccgcacgcgacacagtccgatgcgtgccgcggcagaaccgcatagtgttcgcgcactgtctccggcatgccgccctgtgccttgcagagatttaaaaattttgtaacggatgcaacatcgatccccttggggcagggcgcgcagtgtccgcaatacatacagtgtccctgccagcttatctttggaaatgctgcgagcgcggcggcgtagtcgcgctgctcttgagaagcgtccgaataggaaaggcaatcgcgcagctcgtccatggtgcgcgccccagccatcaccgaggcgacggccggccgtgtcagcgcatagctcatgcactggtacggcgtcagcgcgcggccggccggggagagcgtctcatcaagcaggtcgccgccgccgaacgccttcatcacggtgatcccaacgcccatccgctgacacacctcataaagcgcctcgcgctccgggtccatattgaccagcggtttctcgtagctttgttcagcccacagcagttccaggtcctcgtttgcgggctggaggtcgtagcatggattgacgctgaacatcagcacctcgatcagcccgctttcaacagccttgcgcgccgcggcgggattgtggctggaaagcccgatatgtccgatcacaccgtcctccttgagctgctgcgcataacgcatgaccgggccgctgtacgcctcctcccagtcggccattgaatcgacataatgaatcatcccgatttccacggacgaaagctccatgcgcgtcaataaatcctcaaacccctccttcacctcgtcgattttgcgggtgcgcttgtactggccgtccttccatatcgtgcagagatgcgcctgtaaaacaaaccggccgcgccggccgcgcagcgcccgtccaaggcttgtacgcatctcgggattcggggtatacaggtcgatgcagttgcagccgcgctcatccataaggccgatcatcgccgaaacctcctcgggcgttttttccaaaaagccctcgcagcccataccgacctcgccgacaagcagccctgtattgcccaatcgccgtttgttcaaaatacatcttcctttccgtctttctgccgcaaacaatctgcggaagcatgctccgcgttgtacttatcataatacgaaacaggaaaaaagtaaatcggaacggttcttatattaagcgcggcatcccatgtcatcgaaccaaaatatcccggcgcgtttgaacagattgtcgatctgtcctcttgctgggatgaacatgcattattcgaatcgcgtgaatcgatcatggcgctttcggcgcgaatcagccgatgccatgagcattgctgccgctttttgggcgcggccggcagccttaccggcgatacataccgcattgcgctcgacgccaccacctcctccaaggtggcaaaggcggcgcggcgtctggcgctcggcgccttcaagggcgggccggaggggcgcggccgcgaatcggtgcgctttctttcctgcgtgaccaacaagggcgttttgacgtttgaggatacagcccgcgcgctgtgcgaccgcctctatctgatcgacgacgtatacggcgcggcctcccggcttatgctgggcgcgctgcgcagccatgctctcgaaatgggctgggatgtcatcacctgttattgtccgctgttcccgtttgaaaaaatcgatcacctgtttatccccgcgctcaaaatcggctttatgacctccaacgattttcacaagccgcagatcgaaccgtataagatcatccgttcgcgccgcttcaccgacgctgaacaactgcgcgcgcaccgcaagcgcatcgccttcaaccgcaaggcggcggcgcagatgattgagcaggccggcaagctgctggccgaggccaagcgtctgcacgatcaactggaggagtactaccggtctgcgatggactttgaaaaggccgacggcgtttgccgcgcgctgctgcaaaaatatgagcatattctgtcccgctacggcctgtaatctgcaaaaaaggggctggtatcctgtgatgccagcccctttttaaccggtcaatatttggaatccgtaaatatcaagctgtcaggctcctccgccggctcgtccagcggcgcttgagcggcggcgccgcgcagccggaactggccgaccagcgatctgacaagccccgcctggctggacagctcctcgctggccgcggcgctctgctcggaggtcgcggagtttgtctgaaccacggaggatatctgatcgatgcccaggctgacctgttcgatcgattcggattgctggcgcgacgcctccgcgatccggtcgagcatctgcacaacgttgccggctccctccacagtgcgcacgagcgacgctgccgtttcgtccaccagattcataccgttgtgaaccgcctcaagtgagcgttcgatcagcgccgccgtgctcttggacgcgtcggcgctcttgccagcgaggtttctcacctcgtccgcgacaaccgcaaagcccttgccggccgcgccggcacgcgccgcctctacagccgcgttgagcgccaggatattcgtctggaacgcaatatcctcgatggttttaataatcttactgatctcatctgacgtgctgttgatttcgctcatggcggcgaccagatcctgcattttgacattgctttgccgcatatcgtttccaacgcgctgtgcgttttcattggcgctgttcgcattatcggcgttttgctgcacgtggtgcgagatatccgcgatggtcgcagccaattcctgcaccgaactggcctgctcggtcgcgccctggctgagcgactgggcgcttgcagccacctggtcggacccgctggcaacctggtcgacagccatgctgatctgagaaagcgtgttgttgatggagtcgttgatctgcttcatcgattgctgaatagcgacaaaatctccctggtactggcgggtcatttccattgtaaaattgccctgtgccatttcgtccaagtgcgtggaaacgtcgcgcaccacatcggccaggcgtgtaacagtcgcattcaggccgttcatcaggccggccgtttcatcctttgaatgaatctgcggaaccggcgtgtgcagatcgcctgtcgaaagcagatccaaacgctccatacaggccttgatcggattggcaaccgaacgcgccagccgcacggcgatcaggacgcctgccacgatcacaatcaaaacgatcaatcccataacgataatactgtttctgagcggggccataaactcggcctcgctgaccgatacgcctatgctccagccctgttcgccgctgatcggcacataaccgaacagtttgccgtccccattataccgataggtatcaaagccagattccccctgaagcatgcgttcatgaagcgacgcaagcttcgtcaggcttctgtcatttttcgcctgctcgatcatattgacgccattgcttacataggatgcgtccggatacgcgatcacattcccgtgcgcgtcgagaatgtacgcatacccgctttcgcctatattcatgctccggacaacttctgtcaaaaacgccgcgtctactttgccataaaccaatccgtcaaatttaccgtctgtcagaattggagacgccataataaaggcctgccggtcgccctcatagattatatccgagatcgccggggccagcgtttgcttacacgcctcaaaatatgcctgaccgctttcgtctcgggatccagcgccgacgccgcgctcgtccaacttgccgatttcgatgaatccgttgcgcgatgcaattcctgccgagcgctcgatcagcgctgcgtccgacgggccggacgtatgatagacatcaagagctgccgcttcagtcaaagtcgaccaatagttatccagcttttcttcaatcgttctcgaagccacctgcgcaatcggaacgattgtggtttcaagcacttcgtatgtgctctgtacctctgtgacggcggcgattcctcctatcaaaatagaaccaactaaggctaccgccagcatactcaccaggatctttgacttgatggatttcatatgttgtttccctcctgccctttcagatgccgccatggctatcagaaggactttttatagcattctttaacatatagatgtcttccttttaattataatttaatcattgtatgaatcaaccattttcataagaatttctgcataatatgtgcagattatataaaattctgtaatatattttaattcatacaatgcatatcaatgtatctgccctttcattacaagtttaaagataaaaatacgccatcatcccacgagagatgacggcgtatttttaaatcaatatcacaccgctgcaaatacagatacaccggcttttcacttctgcatcttttcaaactctttatcagaaagctggattgaaacggaatggaaatcctcatcgctggtcagatagctttgaaactgtaccaatccccgcttcgcctgaagcgtgtaagtctttttcgacgcgtcctttttttccttcgcgccccattcctgcgcggcgtaatcgaatgacaaatcctgtacgcttacgccgttatatgcagcctcaaccttttccgtcgctgttttggtaagcgtcacagtctgcaaaatcccctctgaagcggaaagagttgtttcctcggtaatatctgtgttgccgctccacggcacgctgacagtcgcaaaaatctgatcgcccgcgcccctgcttagactgtaattaaatgaaatgtatttttccccgtcctgcgcgaaatccggcatcttttccagatgcgcctcgtagccgcggtcgacaagatcctgtacggttgtctgcccgaggacgatggtatagccgtccagagtggcctccatcggcatatcagccccgccgcacgccgcaagcgccaaaagcatcattatcgcggccagcagtgatacccaccttgttttcattcgtttcctctccttcattctattgctccgaaacgccccgccgttaagacgcaggccggcccggagtattgacggtttctattatatattctctcccatgttttgtcactatttttttaaagattttccacagccgcccgtaaacactgtaaaaaccgaccttctctctacgcttcccgcaatgcgacggctctaatattttgcctcgctccgtgacggcagcaaacggtcatggatgcgaaaacgccgcacgatgaaatcatcgcgcggcgttttgtgttttaagagcacagtttataatggcgtcccggaatccttttcctgcgtgatggcctgcatatcctccagggaattttccagatgttcggtcatcagcgcgacgccggcttcggcgttgcgcttttcaaacgcgctgagcagcgcgtcgtgcgtggtaattgcatgtacggcgttatcgggcagctggtaggtctgcatacggtaatccatgatacattcggcgatgatcttttccattctgatcagcagctcgttaccgctcgcctccgcaatcttatgatgcagctcctcatcgtaaaacgccatcttgacatagtttttcgcccttgcgctctgcacgaacagctcatgcagcacgcgaagctgttcaagctgccggtcgctcatgcgctggatcgccagacgtgtggtcatcgtttcgatggcgatgcgcacctccatgatgttggtcagccgctggctgtgctcgcggaaccagttggccacatagctgtcgtcggtgcgttcctccggaaagcccttgaaataagcgcccttgccgcggcgcacgtcgatcatgtcgatggcctgcatcatccggtacgcctcgcgcgccgttgaacggccaacgccgtacatttcgcagatttccttttctgtcggcattttatcgcccacatcgatgtttccttcgacaatgtattccttcaaattgttgatcacctgatcgacaattgaaatccgttcgatcggtttcataaggcccaccgctttcaacatggaattgcccaaggctcgtactagctttgtccgatcacaagacaacagggcgggacgtgtccgtttctattataacacttccaacatttctcatcaagagcttgcttaaaaatagaaggcttgcctgttcatttatattcggtatgtaaaagctaaaagcctatttcatgacgcgtgcaaagttcttgcggattttttcctgaagcgctggttcgtcgatcccgacattatcaaaaatgaaagcgagaatctgctccagattttcctcagtcggctcgatcccgagctgtgaaaactgcgtcggcgtgccgatcagctcaagaaaacgcacattcttttcgatgtactcctctgaatatccattgaccgcaagctgcacgggaatgccgcacgagacgatctcaccatgcagaagccttgcgcgctgcggtttaaacagcttgctgacggcgtcgtaaaggccatgtgcgaccgcaagctgcttgctgccgctcgacagctgcgaggtcaaacccgtcagcgcaagattcgtgaagatgatatcgtcgacaaccggcgtaagcgtgccgtccgcaacctgtaaaacggcgttggccgcgtctgcaaaatatttatctgtgttcgatttggcaacctgcaaagccgaaaccggcatgattgtgatatcccagcccttgacaaagcgaatactgaaatcgatttcaggatacttggccatcgcgtccgccacgcctgcggccagcatgcgcgccgggcaccggcgcgccagcaggtcggtatcgaccagcacagcggccaccggctggcggcagtattcgttgcagtccggcgtcccggtatcgtcgtacttgatacagaccgtcgcataacacgcgcaggtagccgccgacgtgggcacggtgatgacgcggacgccgagacggtcggccgccagcttgaccgtgtccatgcactttccgccgcccacaccgatgatcagccgcgcgccgaacgactcggcatcgcgcacaatcgcgccgaccgtcgtctcgctgcaaaagccggaaaacggatgaaacagaaagtccacgccgtttgcacgcaggctttcttccacctgttgcccggcgatctgccacgcggtcgcgcccgccgccacaatagcccggtccgcaaaaaatttcgcctcccgcccggtcagcgcggcagcccccggcgtttggatatatcttcctgctccaagaatgatctgtgctccatctctcatttcaatacagctcctttacgacatggattcggggtttaatcgaaagacctctatcgctgtgtgtgaaaaaatttgctcgagcgcggccggatcccgcaccgcctgacggtatttgaacagctccccggccgcctgcgcaggcacatcggtggaaaacatcagcttgtcaggcggcagcgcctgcaaaaactgctcgatattttctatgccgacgccgctcggctccagccagacattgtcaaacgcctgcgccaacagcattgcctgtaccgaaaaaaagtcggaaccggcatgtgcgatcacgatgcggacatcggaataatcgcgcgcgagcggcgtcaggcgaaccgggtctgcgaacgggacgcccatgccggtgtgcaccatcacagggatggacagctcccgcgccgcgtcaaagacctctcgggcgtcacgcgacagcagatcgaccgcatggccgttgggcgtcagcttgacgccgacaaaaccaagctcttttacacagcgccgcagctcggcgcggtaatcgtccggcctaaaatgcggattgatcgaagccatcccccatatccgtccgggatgtgcctggcagagcgcggcaatccggtcgtgtgcggcgcgcgtatcctccagatagggccgtgcaatgcagggctggacgatcgcgccgccgattccgttttctgccattgtgccgagcagccgcgattctgtcacctcaaaatcgtaaaccacatccctgccaagatggcagtgcgcgtcaatgatcatgcgaacctccttaattgattaataaaattattataagattgtctgacatcttaattgattataacagccctttttcagacttgtcaagcttttgttttttgtaatacaacaaaattttactatatatttttattattttatacaaagtttcaaaatacatgttgacaaccacaagcatcccgtctatacttttagacacgatatcagacaacattacagcctgataaatattacaatttatgatctggaggaacacagcatgacaaggaaagagttcaccgcaaaatacggccgcattcttttgccgctggtcacgcccttcggcaaggatgaggaaatcgactacaaggtctatggcgatctgattgaatatctgatcaaaaacgatctttgcgattcgctgattgtcaccggtacgaccggcgaagcaagcctgctcacctttgacgagcgcgtgcgcctgatggaaacagccgtccgtgtcagcgccggccgcaagccagtcattgccggcacaggctgcgcctccacaaaggaaacggccgcgctcaccaaaaaggctgcggagctcggcatcgatctttgcatgatcgtctgtcccttctataacaagccgacgcagcagggcgtttacaaccattacaagcagatcgccgaaagcgttaacgtcaacatcctgctttacaacattcccatctttgtcggcatcaacattgaggcccaaaccgtccatgagctgtccaaaatcccgaacatcatcggcatcaaggacgaggccggcgtcaatccgacccaggtcacggattattttctggccaccgaggacaccaatcccgaattcgttatcttcaacggcgacgacatcatgcttctgccgaccatcgttcagggtgccatgggcatcgtaagcggcggcgcgcacatcttcggccatgaaatccgcgcgattatggacgccttcgccgccggcgacaacgcccgcgcccgcgagctgttcatcccgctttaccgtttctgcaagagctgcggccagaacggacgcatcctgcccaactcgatcatgcgcccggccatcgagcttgtaaccggtattccggtcggcccggcccgcagcccgctcgcccccatcaccgaagcggaaaaggctgtcctcaccgacgtgctcaggcaggccggcaagctctcctgatctcccgcataccttttttgaaaaaaaggtatgccaaaaaactttagccggctgcgctccggcttttttgaaaaaaagcctcggcaaaaaactttagccggctgcgccgcgaacagcggggcgggtacagcgtaaaaacaggccgcgccgcaaatcgcgggacggacgccgcgccggttctcttaaggatgatccgctcaccctgcatctgcataagcatctggctctaactgaaaaatgggaggaatcgaaatgaaaaagcatctcgcaatcctgcttgcggcagcgatgtccaccacactgtttgccggctgcggcggcgcttcgcagcccgccgcctccagtcaggggaccgccgcgtccgcaccccagagcagcgcctccgccgcgcccgcggatgggacggccgcgaccgacggtgaaatcctgttcggcctgagctgcgcactgaccggcaacttcccgctggcgggccagcgtacccgtgaaggcatcgacctggcattggaggaaatcaacgcaaacggcggtgtgcttggcaaaaagctcgtctatacgattgaggacgaccagaacacccagaccacagcggtcaacgtcgtcacaaagatcttgacgcaggacgtcgcggccgtcatcggaccgcatacaagcggaaacgcgatggcgaccaatgagctttaccgcaatgccggcgtcccatttttaaccggcggcacaagccccaagcttgaggaggctcaaaatccctacatgttccgctgccgcccggcggatacaatcaacggacaggtggcggccaaatacgccatcgagacgctcggcgcgaaaaagataggcatttcctttaacaataacgatttcggtactggcggacgcgatgtgatcattgcctaccttgaggaagcgggcgtgccgtatgtagcggtcggccacaatgccggcgacaaggatctcaccggccaaatcatgcagctcaaaggcgagggcgtcgactgcatcatctcctggaccgacgacgcagaggtcgccctgaccgcccgtcagctctatgagcttggcgtcgacgtcccggtgatcgcatcggcgggcgtcgttatggatcaggtgctcaacctgctggaacctgagtatgtcgagggctggtattccgtcaccgattttgtatcgaccagcgatgaagctgtgaccgccgagtttaccaaaaagtttaccgacaagtacggctatgcccccgagctttacgcagctacctattacagcgccacctatgtgctggccgatgcgattgagcgcgctggctcggccgatccgcaggctgtgcgcgacgcgctggccgcaaccgatgggctggtcctgcctgaaggcagctacaaatgcgacgaaaacggcaacctgctgcacggctgcgtcatcgcacagatccgcgataaggtcccgacgatggtcgaatacgtcgatctcgcggcgtaaccgcacagcacaaaaaaaccggccccgccggacccagtccggcggggccatccaactataaccggctgttttgcgcgcgccgctggcaaaacagcggatcataaggggtgaaagaattgacagccgaaatcattgtccagttgattgtcagcgggctggcgctcggctttatctacgcgctcgtgtcaatcgaatacaccatcatcttcaatgcaaccggcctgctcaacttcagccacgataagctgattatgctcggcgcctatgtgttcgccggacagttcgtcctgcgcatgggcgcgccgccggccatcgcgatcatcgcaaccgtcgccaccatgttcctgttcggcgttctggtcgccaccggcattttcaacccgctgcgcaacatggcctcccccgtgttcgcggtcatcggtacggttatcctcggacgcatcctgaccgagctggcccgtgtcatctggggagcgacgccctttacagttcccggctttctcaaggggatcgtcaagatcggcagcatcgtgattccgcgggccaatatcgctatcatccttgtctccgcggtcattgtgaccgctttgcagatcttttttaaaacaacgaaaatgggcaaggcgatgcgctgcgtccagcagaacaaaacagccgccacgctcatggggatcaatgtgaccgccaacatcaatctgacgatcgccctcagcgcggtcatctgctccgccatcggcatcctggttatcccgctgttcaccatcgatctgaccatcgccaatatgatcggactcaagggctttgcagccggcgtcatcggcggcttcggctatctgcccggcgcgatcgcgggcgggattctgatcggtatccttgaaaatctgagcacccttgtcatcccgaccctgtataaggactgcgtggcgtttgtgctgttgatcgtatttctgcttgtaaaaccgtccggcctgctcggacacagacagtaaaggaggcccgctatgaaacggatcaaacgggcggcgctctgcctgctgctgattttcctcgtcgtattcccgctttcgtatgacaacgcttatgtacatatcctgctcagtcagacgcttgtcaatatcgtcattgtcatgggactcaatttcatcaccgggctgaccggccagatgaacctgggaaccgccggcatcatggggcttggcgcttatacggcggcgctgttcagcacgcgcctgggcgtgtcgccctggatcggctttctgctggcgatcgtcatggggctggccatcggatggatgctcggctatccgagcctgcggctcaagggcgtctatctgtcgctgacaacgatcggcttttcagagatcgtgcgcctgatcctgaccaactgggtcgagctgaccggcggcaccatgggcgtgcagggcatcccgcacatcagcctgttcggttacgcgctggatacctcgcgcaaggtctactacctgtatctggccgccgtcgtactgctcgcgttcaccgcgtggcgcattgtccattccaaatggggacgcgtgttcaaggccatccgcgacaatgtggaggcggtcgaagcgtgcggcatcgacatcgccaaaatcaaaattcaggccttcacgctggccaccgtgttcggatgcctgggcggcgcgatgtacgcctatctgatgggctatctcaacccgacgacctttacaaccgatctgtcggccaactatctgatcatgatgatgatcggcggcatcggttcggtgccgggcaacatcctgggcacggcgatgatcacgctgctgccggaatgcctgcgctttctgggcacgaactactggctgtatttcagcatcatcgcgcttttattcgcgatcttcctgcccaacgggcttgtatccctgtttggcggtgaaaaaaatctcggccggttctggatgccgaaaaaacaaaagagcgggaggcgcgcatgatggaacctgtcctgaaaatggagcatgtcacaaaacgcttttccggcctggtcgccgtgaacgacctgtcgcttgaaatgccggaaaactgcatccattcgctgatcggcccgaacggctccggcaagacgacgacggtcaatatgatcacgggcgtgctgcctgtcagcgagggcgagatcttttaccgcggcgtcaaaacaagcggcagccctgtctaccgcatcgcccgtctcggcgtggggcgcacattccagaacctcaagctgttcgggtccatgagcgtattggaaaacctgatgatcggcgcgcaccagatgacaaagatcgggcttgtgcggtttctcgtcgacctgcccggcgaaaaacgagaggaaaagctgctgaccgaacgcgccgaacaggtgctcgaggagatcggccttgccgacctgcgccatgaaaaggtcaaaaacctcgcctacggcaagcagaagatgaccgagcttggccgcgcgctcatgctcaagccggccctgctcatcctcgacgagccggccgcagggctgaacccttccgagcggcgcgaatttgtcgacatcctgttaaaaacacacgagcgcgggatcgatctctttttgatcgagcataacatggacgtcgttatgaatatcagcaccaagatcactgtgctcaacttcggcgcaaagatcgcggaagggaccccctatgaaattcagaacaacgacgaggtgatccgcgcttatctcggcgacaaatacaagccggtggagggttagtctatggctatgctgaaagtacatggaatcgacgtgttttacggaaacgtccaggccctgttcgacgtctccattgaggtgcacgaagatgagatcgtctcaatcatcggcgccaacggcgcgggcaagacaaccctcatgaaaacgattatgggcatcaaccgccccgcacgcggcgcagtcacctacaacggcgagcagatcagcgacctgaaagcgcatctgatcgtcggacgcggcatcgtctatatccctgaggggcgcgaggtgtttccgcagatgagcgtgcttgaaaatctggagatgggcgcgttttgcaaaaagtatacaaaggcgcagcttgacgagcacatcgccgaggtatacgaactgttcccgcgcttaaaggagcgcgcgcgccagcaggcgggcaccctctcgggcggcgaacagcagatgctcgccatcgggcgcggcatgatgagcgatccgaagctgatcatgtttgacgagccgtcgctcgggcttgcccctgtcatcgtggacgagatgttcgacgccatcgtcaaaatcaaccgcacacgcaaaacgcctgtcgtcattgttgaacagaatgcgtttatggccatgtcgatctcctcgcgcacctacgtgctcgaggtgggccgcatcgtcaacagcggcgacagccgggagctgctcgacagccccgatatcaaaaaagcctatctgggcggctgacgcgcgccgccggctggcatatgaaaggggcggcaaacgccatgaagcttgtcagatttctttataacgggcgcgagcagtacggcgacttgcaggcggataccatccgcctgcttgacggcgctttggacactggctttacaccgtcggacaaatgtgccgcgcgcgccgatgtacgcctgctcgcacccgtcagaccgagcaaagcggtctgtatcgggcttaattatatggatcacatcattgaatcgcacgaaaaggtccccacatcgcccgtcgtctttatcaagccctccacggcggtcatcgggcctggcggccgcatcgtttatccggcgcagtcaaagcgcgtggactacgagggcgagcttgcaatcgtcatcgggcggcgcgccaaaaacgtcccggaacacgaggcggccagtcatatcctcggctatacctgcgccaacgacgtgaccgcccgcgatttgcagccctcggacggccagtggtcggttgcaaagggctttgatacgtttctgccgctcgggccctgcgtcgataccgaggccgacccgtccggcctgccgatccgcaccatcctcaacggccgtaccgtgcaaaactcgaatacgcggcacctgctctttaagccgctctggatcgtaagctggctgtcggcggttatgacgctcctgccgggcgacgtgatcctgaccggcaccaccctgggcatcggacccatgcagcccggcgataccgtttccgtggaaatcgacgggatcggacggcttgaaaacactatcgtatccgacggcgcaaagggggaaacggacgtatgaacatactggtatgcatcaagcaggtcccggcgtcaagcaaggtggaggtggacccgcagacaggcgtgctcaagcgcgccggcgtggaatcgaagatgaacccatacgacctgtacgcgcttgaaacggcgctgcgcctgcgggaggaacacggcggcagcgtgacggtcctcagcatggggccgccgcaggcgcaggcggtcatccgcgaggcgttcgcaatgggcgcagacgccggcgtgctgctctccgaccggcggttcggcggtgcggacgtgctcgccacaagctatacgctcgcgcagggcgtgcgccgggcgggccgcttcgaccttctgatctgcggtaagcagacgaccgacggcgataccgcccaggtcggcccggagatcgccgaatggctcggcatcccaagcgtggccaacgtccggcggattgtccgcgcggagaaaggcgccgtcgtcgtggaggcggatctgccgcaaagccttgaaaccacacgcgtgcagtttccgtgcctgctgtcggtcgacaaggacatctgccagccgcgcctgccctcctatgtcaagctgtgcgccagccgcgaacggcccgtcacggtcctgacgctcgacgatatggacgaccgggatgaacggcattacggcctgaacggttcgcccacacaggtgcggcggattttcccgccggaaagcgacgtgcgccgggaaatctggcgcggttccggccagacgctcggcgcacgcctgtacacgatgctgcggcagaaaaaatttgtatgagagggggtgcgccttgtggcaaaactggtgatccatcctgaaaaaatcggcgacacagccgcctttatccgcctctgcccattcggggcgcttgaggagcggggcggtacggtacaggtcagcgccgcctgcaaaatgtgccgcctgtgcgtcagaaaagggccgcccggcgcggcggaatacgtcgaggatacagcggcgcccgccgtggacaaatcacagtggagcggcgtcgccgtttatgccgaccatgaggaaggcgtgctgcatccggtgacattcgagctgatcggcaaggcgcgcgaactggccgccgtcatccggcagccggtccgcgtcctcctgatgggcggcggcgtcagccaagccgcccacgagctgcttcactacggcgcggacgaggtctatgtctgcgacggccccgcgctgcgccatttttccattgaaccgtatgccgccgtctttgaagcatttatcgcacagacgcgtcctgcggcgatcctggtcggcgcgacggctgtcggccggcagcttgccccgcgcgtggccgcgcggctgaaaacggggcttacagccgactgcacagtgctggagatgaatgaaaacaccgatcttgtacagatccgcccggctttcggcggcaatatcatggcggagatcgtcaccccgaaccatcgtccacagatggctacagtgcgttataaggtgatgaacgcgccggaacggtcgccgcacagcagcgggcagatcgtcagcctccacgtcgatccaacccgcctgaagggcggcgtgcaggcgctcgaagccgcgccgaagccggaggaaaaatacattgaatcggccgatgtgctcgttgtggcgggacgcggcgtcaagaaggaggaggacctggccatgcttgaggagctggcgtcgctgcttggcggccagctcgcctgtacgcgcccgatggcggaagccggctggatcgacgccaggcggcaggtcggcctttccgggcgtaccgtgcgtcccaagctgatcatcacctgcggcgtatcgggggctatccagtttgtggccggcatggaccatgcggagacgattgtcgcgatcaaccgcgacgaaaaggcgccgattttccgggtggcgcattatggactggtaggagatttgtacgagattgtcccgcatctgctcggccagctccgggaacgaaaggaggcggcggtatgcgcgaacgtctgacggaacacgatcttacattcctgcggcagcttgcacaggaccccgaccgggtgctggccggcgatgagatcagcgaggaatacagccacgatgaattgagcggcacagccggctggccgcaggcggtgttccgcgcaaaaaacgtcgcagaggtttcggcggtcatgcggtacgccaacgaacacgccatcccggtgacgccgcgcggcgcgggtacgggactggtcggcgcggccgtcgcggtcgcaggcggtatcctgctcgacctgagcctgatgaaccaggtgctcgagcttgacgaagacaatctcaccctgaccgtcgagccgggcgtgctgctgatggatctggcggcctatgtggaggagcgcggatttttttacccgccggaccctggcgaaaaatcagccacgatcggcgggaacatcagcacgaacgccggcggtatgcgcgccgtcaaatacggcgtcacacgcgattatgtgcgcgcgctggaggttgtactgcccgacggggagatcgtggagctgggcggaaagattgtcaaaaacagctcgggctacgatctcatggatttgatcgtcggctcggagggcacgctcggcattgtgacaaaagcggtgctgcgcctgctgcccctgccgcagaaaacggtcagcctgctcattccgttcccgacgcttggacaggcaatccgcaccgttccgctgattatccgttcgaaggccgccccgacggcgatagaatttatggagcgggaggtcattgcggatgcggaggaataccttggcaaaaagtttcccgaccacagcgcggacgcatacctgcttctgaagtttgacggcagctcggcggaggagctagagcggctgtatgaaggcgtggcgcagatctgtttggaacagggcgcgctcgacgtgctgatctccgacaccgaggaacgcgacgaatcgatctggaaggcgcgcggcgcgtttctggaagcgatcaaaggctcgacgacctgtatggacgaggtggacatcgttgtgccgcgctgccgggtggacgctctggtggagtatacgcacgggcttcaggccgagcttggcgtgcgtatcaagagcttcggccatgcgggcgacggcaatctgcacgcgtatattctgcgcgacggcctgccggacggcgtatgggaggagaagctcgcgcttgcgatggaaaagctgtatgaacgcggcaggcagctttgcgggcaggtatccggcgagcacggcatcggctacgccaagcgcgcttatctgagcgagtctctgccgccgcgcatactcgccctgatgcgcgcagtcaaacgcgccttcgaccccaagggcatcctcaatccgcacaaggtctgcgaaccatgaatcgaaaaaagggcgtgggagccatggctcccacgccctttttgatgcgctgcctcaccgcggcgcgcgccggtggaacgcgcgcgccagcgcgcgtacaagcgcgtcgccgttctcgccggccggctgcacgaccgcctgcacagacgcagcgccgcagcgcgcccgcagcgtttcaagcgcacggcgcggcctggccggcgcgcttaaaatttccagccgcgtatatcccggatatccccgcgccaaaaccgcgcggatgcgcagatattccgcttgcggcagcgcctcaatggcggcgcgcagcgccccggcggcttcgtccgtctcaagcgcggcaatcatcagcgcgtcgcagccggccggcagcggtccgtaaacatacgcctcgtgcgggctggcatagagctgctcataaagcgcctcctcggcgggatttgaaaattttccataatagacgtgcatcatatcgcgcacaacgctgtaaataaagcacccatgcccggctttttcaaacgcggcggccacagcgcgtgcagcctcctccggcattgcgcgcaggtcggaataacgcgcgctgtcgatatcgtacaaagccgccccgtcgaggcacacgaccggcaggcgaagctgcgcgccgtcaagcagcggcagaaacgacgacggcgtccggtccgtcacaacggcgatattcgcgccgcgttcggcaagctgggtcagacggatgcgtgtgaacgcggtcatccgcccgctttttccaagcagcccgccgtcgagcgcgcacgcaaacaggatctcccggcggcgcggcagcggcaggtgcgcgctgttgaccgcaagcgatacgccgatgccgatcagggtgtcaagaatgcggttgaatgcaaacagatacggattgacgtccatgccgtgcgaaaccgcaacgctcataaagaccacgcaggtgatgtaagaggcgctcgtctcccgaagcagcaccgtgatatagatcagtacaatcaccatgagcgacacaagcaggtattgcacaaccggccagtcccgcggcagaaacgcgcgttcaaacaacagcagcgccatgcccgcgcacccgccgatcagcgtacccacgacgcggttgagcgcaaccttgatgctgtttgaaacatatggctgcatgcacaggacggcagcgatcgccgagtaaaacggcacgcccgcgccgccgcgcagcaggtcgatcataaagcacagaaagacggccgcagccgatttgataatacgcatcccgatgtgcggcatgaagccacctccctctcggcgaaaccgcctgatctaaatacaaagatgatacgcgccctgtcccggcagccactcaaatcaggcggatgggcattcgttcaggccgcctcgccctgatcccccgtcccggatgatggggagcgcatattcgacgcatactgaaagctcccgtcctccttaagcgcgattgacagcgtcccttcccacatcacagtcgtatcgtccgccgcgctgaaggccgcgtaatcgagcgtcagcatatcgccgtccagagccgcgcccacgacacgcccggacgcgccgccgccaagccctgtgaattcgtaggcgtcccgctgcgcgtcataccgggcgtgcgcacgcatcgtctccgtcgggtccgcggtgaaaaattgccgcacatacgcctccacctcagccgccgggaaaaagccgccgctctgttcaccgggatgctcctgtgtccaatagatgccataaaaatcgatcagcgccccgccgtcaatctcctgaggcgtatcccagctctgcgcggtcacgcccgaataaaacggctggcgcagatatgtatcggtcagcatatcgtaatcagtcagatcgaccgcatcggacgcggccggcgaggccgtgtcaactgccgccgcggacaccgtgccaaaggaagacgcggccggcttctccccctgcggcgcacagcccgccaaaatcgccgcgcagcagaacgccgtgcaaagcacatttctgattttcagattgattcggcccatgataccgccccctttcactgcgcttttttcacgcgcttatgtcaataacaaccgttttcaaataccaaccgggacactcgtgcctgtcaaatctttcagccgcgggtcctgccggacgcgccgggcacgcccatctccccgcggtatttcgcaaccgtgcggcgcgatatgctgacgccgtcggccgccagaagctcacaaagcgcgcggtcgctgaacgggcgtgcccgatcctcggtatcgatgagcgcgcgcagcttatatttaaccgtctcggagctgaccgccccgccgtgctccggacctttgacaaagaaataacgcagcggatagacgccgtgcgcgcattgaagatactttccgcgcacagcacggctgaccgtcgattcatgcaggccgaccagcccggcaatctcacgcatacgcaggacgccgagatgctgcggcccatagcgaaaaaaacgctcctgctgccgcacgatcgcccgcgccacttccacaagcgtcctatttcggttttcaatgcatttgatcacccaattgacctgatcgatcttttcgccgatgtatttgataacctcaggatcagccgtctcgcgcgctatttgcagatagctgtctgaaaggcgcacctgcggataggcaaattcgcacagcatcacattgtaatggtccccgaagcttgtgaccacaatatcgggcgtgatgtaatgcagaagggcatgcgctccataaagcgcgccgggcttcggattgagccggcggatgcgcgcgacagccgcttccacctccccggcggatgcgccggttttcgccgccaggacgcccacacgttttttggcgatctcaggcaaaaagtcccgcgccagccggcgcgcgagcgcatcggaagctggtatctgcaagcagaggcattccgccagatcgcgcgcgccaacgcccggcgggtcaaagctctgtaccagcgcgattgcccgttcgagcagcgcgtcacacgccccggctttggcacgcatctgttcgggatctgcttttagatagccgttatcgtcgagacagccgatcacataccgggccgccgcggccagcgcccttggcacggctgctgattccacctgcgccaacaggtggtccgtcagactttcatcctgcggcgcgggtgtgttctgctccggcgtcaggccgccgtcgtcgtcataatatcccatattctcctgttcgcggcgcgtctgattttccagccattccagctttcgctgcgccagcttttccttttgctcgcgctgtggcggcggttccacctccgcgaccggattttcaagcgccagctccttgaggtattccccaagctgtacgctgtccatctgcaaaatccgcacagattgctccatacgcggcgccaatatctgattctgttccagtctgacgcccagctccatgccatctccaacctttgctttacatttgattttggtctgtgccttacattataacacccgcgcattcctgacgcaatcgacagacgccgtatctgaacaaaaccaggcggcggtttttaaaccgccgcctggttttgtccgtcaaagcttttccacctcagaaagccacagcgcggccgacgcatcgctcggcatacgccagtcgccgcgcggcgacagagacactgaaccgatcttcggtccgtccggcatacaagagcgtttgaactgctgtgcgaaaaagcgcctgtaaaaggtgcgcatccagtaaagaatggtttcgcgcgggtacgcctgaccgaacgcataaagcgccagacgcagcgtcttatgcggtgaaaagccccacctcagcacatggtagaggaagaaatcatgcagctcatacggaccgaccagatcctctgttttctgtgcgatcgcgccgtcgtccggcggcagcagctcagggctgacgggtgtgtcgaggatatcgcacagcgcggcgcgcagcgcatcgtcgcaggcgcgctccgcctcatatgcaaccagatggcgcaccagcgttttcggcactgacgcgttgacgccgtacatcgacatctgatctccgttataggtcgcccatccgagcgcaagctccgaaaggtcgcccgtaccgacgaccagtccgcccgtctcattggcgatatccatcaatacctgcgtgcgctcgcgggcctgcgcgttttcaaacgtcacatcgcgcacagcctcgtcgtgcccgatatcggcgaaatgacgccgcacggacgcagtgatgtcgacgcacgaaaatgtgacgccgagccgttcgcagatgatctgcgcgttgccgcgggtacgcgccgttgtgccgaagcacggcattgtcaccgcgtgcacatcggtgcgcggacggccgagcagctccattgcccgcacgcagacaagcagcgcaagcgccgaatccagcccgcccgagatgccgacgaccgctgttttcgccccggtatgatcgatgcgctttttcagcccatgggcctgcacctgcaaaatgccggcgcagcactggtcgcggccaggcccttttggcggtacgaacggcaatgccggaaccggccgcgtcagctttgtttcggtgagcggcatggaaaacgggattgtcaaaaacgattgcgcatccccggccgggaaagtggtcagtcggcggcgctcaaacgccaggcgctgcacatcgaactcgctgaccgccatcgtctgttcaaaccggcctgtctgcgcaagcatcgagccgttttccgcgatcatgctgtgtccagaaaacacaagatcggtcgtcgattcaccctcgcccgcattcgcatacagatatccgcacacaagccttcctgactgtccggtgacgagcgcgcggcggtaatcatccttgccgaccgtctcgaccgaggctgacagattggcgatcacagtcgcgcccgcggccgcatacgccgcggaaggcgccaccggcgcccacaaatcctcgcaaagctcgacggcaaaacaaaattctccaagctcctcgcattgaaacagcatccgtccgaacggcacctcaccctctccatagccgcgtacaaaaccgcaggaaccgtccggcgcgggcacaaaccaccgccgttcgtaaaactcgccataattgggcaggtgcgtctttggcacaatgcccagtacacgcccctggtagacgaccgccgcacagttatagagctttgcaccggatacgaccggcagtccggcgacaatcagcaccggcagcgcgcgcgtctgcgcgcacagcgacgccagagcggcgcgcgcgccttcaatcagcgtttcacgcagaaaaagatcgccgcatgtatagcccgtcaggcataattccggcagcaccagaaggcgcgcgccgcactgcgcggcgcggcgcgccatccccatagccgccgccgtattgaaaacgcagtccgccacacggatttccggagtcgcgaccgccactttgataaaaccgtcctgcataagaacgcctccccgcagattgctgtccgccgcaaaagcggcacgggaaaaaaaacaacgccgggccgcagccgcaggccgggttcagcgtcacgccggctcatccgttttataccgatgcagccatgcttttttacagataaagtatgtctcatccatgatagcatattccccctgtgattacaagagcagcccatacgcgaaaatgatacagcgccaaaagccccaaaaaagaatcacacagcgccggttcgggaaggcgcttactatatttattgtcaatatctgattatatacagacgaccgccgccagaaggtgctccggcatcgtaatgacgtccagtttttctcacagtttgcagcccgaatccacgcaacccgcctcaatcattctatcttttgcgtttggaatgcctatgataaaaaaatatccgcactgatatatatttttttaatatccatttgattataaacgataaaaaacaaatattagacactttgactaataagtgttaaacttttatcactgtgatttatgcatgaatcaatagccaaaaataaaataattttattgcaatcttcctgctttggaatgcaatggatgtatgcggctttccaatcgcatgttctgcggccggagcgcccaaagacgccgacggagattttcaagaaacgggcatgcccgtttcttgagcagcgatatcgctgctccgttttcggtttttttgctatgggtccggctccaatcgcaccggctgcgccgctgaagctcttgtgcgcatgcgttttttctgacatcacagtgtgaaagacaaaaggaggttcggtttatgaataaatccacagataaaaaaagctccagcagcgaaattgaatttgcatttgaagaagtccccgacagcgcccgaaaaagtctgggcagcattctggtcattctgaccggctataccatctctctgtccaacttcgtcaccggtgcgaccgtcggcttcaaaatgccctttcagcaagccattttggcttgcggcctgggcaatctgatgctgattgtagttgcaacacttctgggaatcatctcctgcaggacagggcttacaacctctgttctggcccgaaaatccatgggcggcagaagttcagccattctttccttcctgcttgccgtctccgccgtcaactggatcgcggtcaatgccgacacctttgccaagctgatcggctccacttttagctggtggcccattccggtcggcatcaccgccatcattgtggtcgcgctgtgggcacagtccgcgatccgcggtgtcaacggcctggaaattgtaagctggctcggcgtgccctgcgccattgtccttaccatcgcctgcgcgatcgccatcggcaccaaagccggctatgcgagcgtctttgcttacacgccgccttctgatttgcagatcagctttgccgccggctccacctcctttgtcggcgcctggattttcggctgtatcgtctcccccgacgtatgccgttatgccaaaagccccaagcatgtcgccgtcggcgcccccatcgctgtcgccatcggcctgttcggccttgaggtcatcggcatcatgaccgcgcaggccaccaagcagagcgactttgttcccgcgacagctgctctcggtctgggtgtgcttgtctttatctgcgcgatcttctgtgtctggaccacacaggacaacaatatttacagcgccggcctggcgctccaaaacgtcatgaaggacaccaagttggagggtaagataaagcatgcctggctggccatcggtatcgcaacagcggccgccattttcgccgctgtcggcgccaccaagtatttgctgcctgtcgtgcagaccctgtctgtgctgctgccgcccatcccgggcatgatcattgccgagcactattttgtcggcagaagcaaagagaaaaagcccatcaactgggtggctatgatcacttgggtgattggaaccggggtcggttacatcgccctgcaatataattttctggttcccgctattgtcagcatggcggtcacattcgtgtgctatattctcctcagcaagactctcgacagcgtcatgaataaggatatttaaatagccgcgggctggtgtatttcaaacaactccaaattccccaccacactgccgcctgaatccaattggattcaggcggcgcttttttgctgagaaaagcgcgcgccatccattataacgccgccgtcccgccaggccgcgcaagggaccggacttcccggccctctgaccgattacagattttgaataaattcgtttacataataggcggccgccccaacggcggaagcctccgtcctgtagcggcatacccggataaagctgccgtctgtctcaaagggattcaggcggatggtcttttggcggaacaggtcaatgtagtcggccatgtacgcccccacgtttccgcctaaaacaatgtcgcagtcatagcacatccgcagattattgaccgctatggcaagataatcgagatattcatcgaacacccgcttaaagccggggttgtctcccgccttcaggcagtcaaaaaactcctctagactgccgtccgtaaaatccgaaagctgctttgtagagcagtaggcgtccaggcagccatgctgtccgcaatagcatctgcgcccgtttgggacaatgcacagatgcccaaattccgccgaacggctgttcacacccatgtagatctcttttcccgtcatattggcgccgcccacgctgctgcttagagaaagataaatcatgggctgttccgaatcagaatcccaattttcggccagtccggcggaattggcgtcgttaaatatgagatagggcgcgggaataaaagccctcagccgttcgtaaatgttggacgaaacattgatcaccgttgcgtaagagatggttttctgatcctcccgcacatggacgggcatggaaatccccacgcccaaaagcttggcgcggtcagccagatggcgttccaacagggcctgggcctgggccgacagcgtttgaaaatattcgtctgaatcgcagaagggcaggcgcagcctttggcttgcaatgatgttcagggccagatcgatcagcacaatggataaatggttccgggtgatgtcgatgccaagggcaaattttgcgtcggggacatagcttatgatattgggcttgcgcccccctgtagattcaaaggaaccgaccgtccggatcaggccggcatccgtgagaagattcagatgttgggagatggtgggaaggctgatgcctgatattctcgcaatattctggcgggaggttttcttttcctgatagataattctgtaaatatttccaaaggactgggttttcgcctgttcagaatacaagagattccctctcctttccaatggtacaatcgctttggaagccgcagcttgcgatagctctactttaaaagataaggtaagatcataaattcgtcaataggtattttttaataaccaaaatggatattttatcatattcatcccatccttttttctcaagttatataaagcatattacaatacaatttgttaaaaaaataattattttccatatattttaaaaaatataggttaattgtataaaaataaaaatgcaatcttgtaaattactacaaacttaaataaaacagttgacaaaactttatgaggacggtagattatagaaaagagaaaacagaaagggaggagaaagcgcgtggacgaaatcaagatgcgtgttgccggagtggagaaatcgtttcccagcgtcaaggcattaagcaatattgatttttctgtccggaagggaacggtgcatgccttgtgcggggaaaacggcgccggcaagtccacattgatgaaaatcatcatggggctgtacaaggctgacaagggccagctttatatcgatgaaaaaccggtagagattaaaagcccgatacaggcgcgggaatacggcatctccatgattgcgcaggagttaaactatgtgcccgagctttccgttgaggaaaacctgtttttggggcgcctgccggtgaacaggctcgggaaagtaaactggaaacaggtccgcaggcagacaatccagtttttaaaagacgaggggcttccctattcgcccgcacaaaagctgaaaaccctgacggtatccgatattcagatgctggaaatcatcaaggcggtcacaaataacgcacagatcattattatggacgaacccacttcctctatcacggaaaaagaagttgcacagctctttaaaaagatcggggagttgaaagcgaagggcgtctccatcatttatatctcccacaagatggatgaggtctttaaaattgccgacgatatcaccatcctgcgcgacggcagcgttgtctccacagaccgggcggaggatctggatttggacacggtcatcgcgcgcatggtgggacgcaaaatttccaacatctatcccagggaggacgtggcaatcggcgaaaaagccatcgaagtggagcacttctgtcagaagggcattttcgaggatatcagcttttatgcgcgcagaggcgagatcgtcggctttgcaggtctggtgggcgctggacggaccgaaaccatgcgcgcagtctttggccttgatccccatgaatcaggcgtcgttaaaatcaacgggaaagaggtatccatcaaaagcacctcggacagtatcgcaaacggcctgatcatgctgtcggaaagcaggcgcgacgacgggattgtcccagtcagaagcgtccgggaaaacgcaagccttgccaatctggggcgatatatttacggcggttacacccataaaaggaaggaacggcaggaagtcggcgagatgttcggcaagatgaatgtaaaaacgccgtccatggataccgagatttccaaactatcaggaggaaaccagcagaaggtgctgcttgccagatggatgctctgcgatcccgaaattatgatcttggacgagccgacccgcggaatcgacgtaggcgccaaatttgaaatctataagctgattaccgggatggtcaaggaaaacaaagccgtcatcatggtttcttcagaattgccggagctgcttggaatgtgcagccgcatttatattatgtgccagggccggatcagcggctgtattaccagggaggaattttctcaggaaacaatcatgatgtatgcaaccggcgcgaaggtccaggattaggagggggagaaaaatgaacgcgaaagcatcccattatctgcaaaaattcagtatctatatcgtccttgtcgttttattcatcgcctgcagctttatcagcccttattttcttcagagcaacaacctcatcaacgttgcccgtcagttaagcgtgggcattttgatcgcctatggagaaatgctcctgatcatcagcggttttttggatctttcagtaggctctgtgctggctttgtccggcgtgctgtctgtttccgtttataaaagcacgcagtcgtttaccgcggcgattgcggtcgcgctggcggtagccgtcggctgcaatctggttaacgcgttgttcgtcgctaatttcaaggtacccgctttcatcgcgacgcttggcatgcagcaggtcgcccgcggtttggcgctttattataccggcggccagaacattcttcagctgggcgatttcgtcaagatcggccagggagccatcggcccaatccctgtgcctgtgattatagtgatctgtatttcggtggtcatctggtatattgtcaacaacaccagatacggccgcgggctgtacgccatcggcggcagccgcagcgcggcggaggcaagcggcatcaacaccaaaaaaagcatttataaatcctacataatcaacggtatcttaatcggtatcgccggcatgatctttatggcgcgcaacaattccggccttccgaacggcgcggtgggatacgaaatgaccggcttgactgcggccatcgtgggcggaacctctttcacaggcggcatcgggaccgtcagcgggaccattgccggcgcgtttattatcgggttccttgagaacgtcatgaatctggccggcgtaaacccctatatccagcagatcatcgagggctttatcattgtgcttgccgtggcgttcgatgttgtaagcaaatccagaaaatcacagaaggtcattgtcaaagaaccaaagaaagcagcctgatcgttggcacaagcgtgcatgaacgataaaaccattcaaaaggagaaaggtgaaaaaaatgaagctaaagaaaatttgtgcagcaatgttaagttccgttcttgtactgtccatggccgcctgcggcagctcggcgcccagcgcggcgggcagcgcgccggccggcggctcagccgccgcggacaatgcttcttcggccgcgggcggagataccggcgccgcttcggctgagaaaaaaagggtttgcttcgtggcgcgagcgagcgcggatacctttgcggcatggatgacaaatgaaatgaaaaaagccgcggagcagtatgacaacatcgagcttacctgtgtcagcggcgaaggcgacgacaataccgagaacgggctgctggaggactgcatcaccaagcagtacgacctggtgatcgtgcagtcaaacaacaacgcggcgcaggccccgtatgttaaaaacctggtggacgcgggcataccggtcatcaccaccaatcccaccacgcatcagagcgacctggacggcagcgacgacaactccgttctggcggggacaggcaccgtggacgccgatcccgtcgcgcaggcgcaggtgagcgcggcgcgcgcggtgagcgaggtccctcagaatgcaaacgttgttgtgctcagaggcccgtccggcaattaccatgcggagaagcggcgcgaggcgtgggatacctatttctttaacgagcgcccggacgtcaccatcctgtatgaagattacgccaactggaacagcgacgaagccatgacgctgatggaatcctgggtccaggccggcacccatattgacgcgatcatctccatgaacgacaacatggctgcgggcgcgattgaagcgatccggggcgacagcaactatgtaaacgcggatggaactaccaatttcctggcttacggcgtcgacgggacggcgcagggctgcctgctgatcaaggaagggctgctgactgcgacggcgcttcagtcggcgtccgatctggccaaaaagaacatggattacgctgcgaaggtattaagcggtgaaatgcaggtaaccgaggtcaacgactatgtcgacgcgccggaaatcaacgccgaaaatgtggacgagtatatccagatctatatcgataacggcgagatctccgcagatggaaatatagcggcataaagatcgtttgtcacaaagcgcccgtcagagcctgcttgccgggcgctttgtacagattgcagcgaaaggggtttgaattgtatggagatgcagaagggcgcttttatgcgtgggatcgatcagatgattatcaaggatattcccatgccgaaagcagggaaaaaagaagtattggtaaagctggaatatgtggggatctgcggttcggacgtgcactattttcaccacggcaactgcggcgcctataaggtggatttgtcaaacgattacatgctcggccacgagtgcgccggaaccgtcgtcgcagtgggggaggacgttacaaatttaaaagccggcgaccgtgtagcccttgagccgggaattacctgcggcacatgtgaattctgcaagagcggccgctacaatctgtgcccggacgttgtattcctggcaacgccgcccgtccagggatgctatgagcagtacatcgcttttccggagaatatgtgttttaaactgccggaaaacatgtccactctggagggctgtctgatcgaaccgctgtctgttggtttctatgcggccaatcagggagaagtcggaacgggagatgtggcggtgatcctcggcgcgggctgtatcggccttgtgacgctgctggcctgcaaagcgcacggcgccggtcagataatcgtcgccgacctggtagacgcccgcctggagaaagcaagggagcttggagccgccgcggtaatcaacagcggaaaaactgatctgttggaggaagtccgccgcctgaccaacggcaggggcgccgatgtggtgttcgaaacagccggctcggccgcaaccatcgcccagactccatttcttgtgcgcagaggcggcacgatcacgctggtaggcatcgctgcgcaggaagaaatcaactacaacttcgcacagatcatggacaaggaagcgactataaaatctgtattccgttaccggaacatctatcccaaggcgattgcggcagtggcgagcggcgccatcgatatcaagcgcatcgtaacccatgagtttgatcttgagcatatccaggaggcctttggcgaagcgatcaacaacaagacagacctggtcaaagcggtgattaaggttcaataggaggctgtatgttatatatcggcacagatctgggcacctccgctgtcaagctcttgctgatggacgaggcgggacagattaaaaacatcgtttcaaaggaataccccctgtttttcccgcatccaggctggtcggaacaaaatccggaggactggtatgcaaaatttgttgagggcgtccgggagctgcttgagggctgcgacagaacacaggtggagggtatcagcttcggcggtcagatgcacggccttgttgcgctggacgaacaggatcgggtgatacgtcctgcaattttgtggaatgacggcagatcggcaatggaaacggaatatctcaatgatacaatcgggagggaaaatatttccaaatatacggccaatatcgccttcgccggctttacagcgccaaaaattctgtggatgaaaaagcatgagccggagaatttctccaggatctccaaaattatgctaccaaaggattatctggcctatcgaatcagcgggtccttctgcaccgacgtttcggatgcatcggggatgctcctgctggatgtcaaaaacaggcgttggtccgcgcccatgctggggatctgtgaaattacagaacgtatgctgcccagagtgtacgaaagctatgaggttgtgggcactttgaaaaagactttggctgctgaattggggctgtcatctcaggttaaagtaatcgccggagccggagacaatgcggcggcggctgtgggaacaggcaccgtgggagatggcatgtgcaatctttccttgggaacatccggtacgctgtttgtttccagcaaaaattttggcgtggaccaaaacaacgccctgcattccttcggccacgcggacggccactatcatttgatgggctgcatgctcagcgcggcgtcctgcaacaaatggtggtccgaggaaatactgcgcacaaaagattttgcagaggaacaggcgggcattacaaggctgggggaaaacgccgtcttttatcttccctatcttatgggagagcgttccccgcacaatgatccgcatgtacgggctttatttatggggatgtcgatggatacgaccagaaaggacatgacgcaggcagttctggaaggggttgcgtttgccctgcgcgattcactggagattgcccggcagcttggaaataccatcaccagcagccggatctgcggaggaggcgctaaaagcaagctgtggcgcaaaatgattgccaatataatgaatctgcgattggagattgttgaaagcgaggaaggccctgccttgggggcggccatcctggcggcagtcggctgtggagcgtatccggatgtggagacggctgccagccgtattgtaaaggtcattgatactgtggagccgcaggcggatttggtttgtaagtatgaaaaaaaatatcagatattcagaaaaatctatccggccgtaaaggccctgtacagggacggcactgaacttgtataagtcgatcccccggcaaaagccgggggattttcatttgcctgcacccatttcctcacggcgttgagatacgcaaaaaatagatgtgaagcacttattttctatgcataagcatagcaaaacggccatgtgccgcctttggcggcacggtgcgagatcaaagcgcgcaagccgggacagctcacatgggtaaaatcttcgtgcgcgccaattttgcctatgattgcggtacatccacggcgtatgaagttttactctatattttaggcttgggctatgctatcataatcatgcggataacatcacagcacaccgcttttcacatcgtgtaagggcagaaaggcggtgcgtatataagagctattgcaccttttcgcttatttgaaacgaccgttccttgatattgtaaaatatatctcggatgaggacaccataccctgaagccctgcggtaagcatgttacagtaaggaaaaggagatgatattgtgaaaagtaagttgttgcggcaaatttcgtctgagccaaacggattaaaagctgacactactgtaagataggcagacgccaaaaccgcccatattgggggcaacaccctcttggcttgtgccaaggatacacaggcagccatgcgcgtccctctttacagaaaaacgcaatgagcaaaacatcggattttcagggcggcagctgccgccctgttttgtgtgtttaaatgtacatttaaacaagttttccaaggcaatctttgttgctgaggcaaaaattaaatgattcatccaattatttccataaactgttatacgatacgacagggggaaataactgtgaagtgcgatgaatcaaaattcattttggcgtgtaatttattggaataccgcttggataagcatctcagtcaagaggaaatggcatttcgaatcgatctcagcgtcacaagctacgctgaaattgagcgcgcgcaggttcacaccaacctggaaattctcgactacatcagtcgggcaacaggtctatctcctgcacaactgctgacacctctctgccaaaatgcccccgcggtttccagcaagtaaactgccagccaagaagcaaccgcagcctagcaggagcctccagggtgggtatatatccatttgattccaaataccattataatagagtaaccgctgcttcttggctagaagggcggttacttcttttaaacacaactatgcagcattcaaacgtttcgccgctgacaaaattccagcggcccggcgattggaggccaaccgactggcgcagcgccctttgtattttcactatcccccctgccatacagatgccacgcagagcctgattgacaccatccttctgctgcaacagaacaagggcggctgatctgtatagatcagccgcccttgtttttcgcacccggaaaaagaaaaagcctggagcgcgatctggctccaggcccttgcctggcgcagcgggagggattcgaaccctcgtgggattgctcccaaactgatttcgagtcagccccgttatgaccacttcgataccgctgcaatttaaacgctgaaggcaaaactttagaaaacagcacacatttcagcaacgttctgtttatcctctgtttaagcattcaaatagatttttattatatcagataacggcgctcctgtcaatcgattccaatcgaaaaatcgattttattttcaggcagaaccggttgaaccacatgacagcgggcatacaaagataacgatgaaataccttgattatccaaatcgtttgtattattattataataggtatttatgtgggcgccgccggccgcggcgtctggaaatatcgtatccgaacaggtgaaaggatgagcaaaatggagcaaactcgcgccaaggaattagcaatcaccgcggcaaagatccgactcgctggtcttgaggcggtacataccgcggcgtccggccatatcggcggttcgctgtcggttacggatgttttgacagttctttattttgacaaaatgcacattgaccctcaaaacccgcaggatccggaccgcgaccgttttgtgttgtcaaaagggcactgtacgcccgcgctgtatccaacacttgcactgcgcggcttcttccctgtcgatgacctcaagctgttccgcagcatcgacggtcatgtttccggacatgccgagatgcgttatgtcaagggcgtcgatatgtcgacaggctccttgggtcaggggctttccgtagccgtcggcatggcgctctccggcaagattgacaagaaggattaccgcgtttacgcggtaatgggcgatggtgagatcgaggagggccagatttgggaggccgcaatggccgccgccaaatttggtttggacaacctgtgcggcgttgtcgacgtcaacggcctgcaaatcgacggcaaaacagccgacgtcatgccgtccgaaccgctcgatcagaaatgggaggcgttcggctggaacgtcattaaatgcgacggacacgatatcgcagctatctccgatgcctttgacgccgcggccgcctgcaagggcaagccttctgtgattttagctaagacggtcaaaggcaagggcgtttccttcatggaaaacaacgccggctggcatggaaaagcgcccaatgacgagcagtatgaaaccgcgaaagccgagcttgaggctactttgaaaggtctggagggttaatgatgggagaagtcattgctacgcgtgccgcttatggtaaggcgctcgtgaaatttggtgagaatccaaagctggttgtactggatgctgatctgtccggtgcaacaatgaccaacagctttgccaaggcgtttcccgacaagttttttaacatcggtatcgctgaggccgatatgatcggcattgctgccggtctggccacctgcggcaagatgccgtttgccaattccttcgccatgttctccgccggccgcgcttatgagcaggtgcgcaactcggtcgcatatccgcgtctcaatgtcaaggttatcggttcgcacggcggtctgtccgtcggcgaggacggcgcgacgcaccagtgcatcgaggattttgccctgatgcgcgtcatccccggcatgacggtcctgtgcccgtgcgacggcaacgagatggaagccgctgtcgaggcgctgcttaattatgacggcccggcctatatgcgccttgggcgcctcgcagtcgaaacggtcaccgattcaattcccggctaccggttcgagcttggcaaaggcgtccagcttgccgacggcaaggatgtcacgatcatcgcggtcggcatgatggttcaggaggcgctcaaagccgccgagctgctgaaaactgacggtatctccgcacgcgtgatcgatatgcatacaatcaagccgcttgacacggaaattgtgttcaaagccgcaaaggaaactggctgcatcgtcacctccgaggaacacaatgtgatcggcgggcttggcgcggccgtcagcgaattcctctctgaaaactgcccgaccccggtggtcaggcacggcgtaaacgatgaattcggccgcagcggcaaggcgccgcttgtcatgaaagcctatcaccttacgccggatggcatcgccgccaaagcaaagcaggctattgccatgaaaaaataatcgcagattattttttcctctatgaccagggcgatgcgcgggcgcagcccgctgccgccctgacggccaattttatcatgccgcactgcggacatgataaaatgaacgttctgcgtttatttttccctttatggctggggcgatgcgcgggcgcagcccgctgccgccctttcagactcaaaacggaggagcgccgggcgctcctccgttttttgattgctaaaataagaaccgccggccatgccggcggttcttttaatcatatagaggcaactgatttaatccgccctcttatacggcgcatcttcgagcgcagccgtaacggctcacgcccgccgggtacataaaatccctttcagaagccgctgccccactattcgcggcgcagccggctaaagttttttggcatacctttttttcaaaaaaggtatgaagtttttcgccgcggccttttttcaaaaaggccggaaaaaggccggggcttagaagcgggaacgctccgtgtagcttgtatgcaggatccgatgcgcaagatggctgccgaactcaccgaaatactccttgtaaatcgtgagcaacgccgggttttcatggctcttgcgcagggtctttgcctcgtcggcgtcatacagagccttggcgcgaatggacttgaggtcgacaaaattacgcacgctggccggctggacaggctggccgccgccgttgacacagccgccgggacagcccatgatctcgataaaatggtaatttttcatgccgctcttgacctgctccagcagctttttcgcgttggcaagccctgaagcgacggctacattgactgtcaggtcgccgatctggtagctggcctccttgacgccggccgtaccgcgtacatcggtaaactcaacctgctcgagcggcttgccgccgacccattccgccgccgtgcgcagcgccgcctccatgacgccgcctgtcgcgccgaagatgacgctggcgccggtgctctcgcccatcggggaatcaaactcctcatcgggcagctctgtaaactgaatgcccgcgcggtcgatcatacgtgcaatttcgcgtgttgtcagcgcgatatccacatccgggataccggaaccggccgcgtcctcgtcgtcgcggcgcacttcaaacttcttggccgtgcagggcataacgcccacaacaacgatatcctttttatcccatcccatcttttcagcgtaccaggtcttgaccgttgcgccgaacatctgctgcggcgatttgcacgtcgaaagatttgggatcatatcgggatgatagtgctcgcagtatttgatccagcccggcgaacaggaggtgatcatcggcaggacgccgccgtttttgacacgctcgacaaactcgtgcgcctcctcaacaatcgtcatatcggcggcgagatcagtatcaaacaccttttcaaagccgatacggcgcagcgcggcgaccatcttgccggtgacgttcgtaccaaccggcattccgaacgcctcgccgagcgtggcgcggatggatggagctgtctggacgacaacgtgcttggacgggtcgttcagcgccgcccaaacctcgtccgtctgatccttttcatagatcgcgcccgtcgggcagacaacgatgcactgcccacagctcacacaggcaacttcgtcgaggttctgctcaaacgcgcaggcgatatgcgtattgaacccgcgttcgttcgggccgatgacgccgatgccctgccatttggcgcaggccgcgacacagcggcggcaaaggatgcatttattgtcgtcacgcaccatgtggaccgcggaatcgtccttcggccattcaggattgttcccgtcataacgatgctcatcgtccaccttgaagtcgtggcagagcttttgcagttcgcagttgccgctgcgcacgcaggagaggcattcctttttatgtgtggaaagaatcagctcgagcgtaattttacgcgcctgctggaccttcttagagtttgtgatgatctccattccctcggccaccggatacacgcacgccgcaacaagcgaacgcgcccctttgacctcgacaacgcagatgcggcacgcgccgatcgcgttgatctccttgagatagcacagcgtcgggatctggatgccggcgtaccgcgcggcctccaggatggtgctgtccttcggcacagagaagggcataccgttgatttttatatttaccatttctttttccatgttggtacactcctttcttatttcttgacgatcgcgccgaatttgcatttctccatgcaggccccgcacttaatgcacttggtctgatcgatcacatgcggattcttaaccgatccgctgatagcgcccaccgggcactgacgcgcacagagcgtacagcccttgcacttttccttttctatgcggtactgaagcagatgtttgcagacgcccgccggacaccgcttgtcgacgacatgcgcaatgtattcgtcgcggaaatagcgcagcgtggacagcaccgggttcggtgcggtctgccccaggccgcacagcgcgttttccttgatgtaatagcacagctcctccatcttgtcgagatcctcaagcgtggcgttgccgcgggtgatcttgtcaagcatctcataaaggcgcttggtgccgatccggcacggcgtgcacttgccgcagctctcgtcgacggtgaattcgaggaaaaacttggcgatatcgaccatgcagttgtcctcgtccatgacgatcaggccgcctgatcccatcatcgagccgatggcaagcaggttgtcataatcgatctccgtgtcgatcagcgacgccgggatacagccgccggacggtccgcccgtctgcgcggccttgaatttctttccgttcgggatgccgccgccgatctcctcgatgatctcgcgcagcgtcgtgcccatcggcacctcgacaagccccgtgttgtggatcttgccgccgagcgcaaacaccttggtgcccttgcttttttcggtacccatcgacgcgaaccactccggtcccttgaggataatctgcgggatgttggcccacgtctcgacgttattcaggatagacggcttgccaaacaagcccttgaccgccgggaacggcgggcgcgggcgcggctcgccgcggtggccttcaatcgaggtcatcagcgccgtttcctcgccgcagacaaacgcgcccgcgccaagacgcagctcgatgtcgaagtcaaagccggagccaaagatgtccttgccaagaaagcccatctcacgcgattggttgatcgcgatttccaggcgcttgacggcgattggatactccgcgcgcacataaatatatccctggttggaaccaatcgtataaccggcaatcgtcatagcctccaacacggcgtgcgggtcgccctcgagcaccgaacggtccatgaacgcgcccgggtcgccctcgtcggcgttgcagcagacatatttctggccggcaggctgcgccttggcaaagttccacttgagccatgtcgggaaaccagcgccgccgcggccgcgcaggccggacgttttgagaatttcgatcacatcgtccggcgtcatctcggtcagcacccggccgagcgcctgatagccgtcgtaggcgatgtattcgttgatatcctccgggtcgataacgccgcagttgcgcagcgcgacacgcatctgttttttataaaagtcggtctggtcgagcgatttgatcttatcctcggcaaccgtctcggtgtacagcaggcgtttgacgatgcgccccttgagcaagtgctcgtcgacaatctccttgacatcctccgccttaacgcgggaataaaacgagccttccgggtagacgatgacgaccggaccgagcgcgcacaggccgaaacagcccgtcttgacgaccttgacctcctctgtcagacctgtcgcggcaagctcgcgctcaaattcctcgatgattttgactgagccggaggatgtacagccagtacccccgcagaccagcacatgggaacgatacatgatgcagatcctccttttttattgattcatcgcgccgatggtgtattccgccactggcttgccgttgatcagatgttcggcgacaacgcgcgcagccttttccggcgtcattttaacgtatgtaaccttttccctgccaggctcgaacacttcgacgaccggctcgtactgacagatgccgatgcagcctgtctgcgcgattgtcacattggagacgccgcgccgcgcgacctcgtccgtaaaagcggcaagcaccggccgcgcgccggcggcgataccgcaggtggccatgccgaccacgacgcgcgtgttgccgctgtcgtcggcacggatgcccatattgcttttcaccttatccctgagagcctgaagctccgccaagcttttcataaacagcgtttcctcccgttcgcatagcgcggcgcctactgcgcctgcgccgtaatttcctgcgtgttctcccggatgaacgaaccgataaacgcgaccacctccggatttgaaagcggcacgtcgccgagcaccgcgcaaaattcgcgcgtgtccgccgtaaacgaggactcgccgcggcggtacgtatatgtaaagtcgatctccgggttgcattggatgagcgagcagattgtcgcagcgatatcccccagcggcatccggtcgatatgcgtcagaccaaaaactgcgcgcaccgtcgtaccgcgtccaggcgccgattcaatcgccaggcttccgcccgtcatctcggccgccatcttcaaaaacggcacgccaagccccaccctgcgcgtcgtgcgcgtcgtaaaaaacgggtctgtcacatgcgcggcctgctcgggcgtcataccgcagccgtcgtcggccaccgtaatcgtcatggtatcgctttccggctgttcatcaaccataatctcaatcaaccgggcgccggcacgcaccgaattctgagcgatatccagcacattcagcgacaattcctgcattcaaactcacctgtacttcgcgaggattgtgtcgacatcgtccacggtcaaacggccgtagacctcgtcgttgatcgtcataaccggagccagtccgcaggcaccgatacagcggcaggcgtccaggctgaatttcccgtccggcgtgcacattccgctttcgatgccgagcttttcctgcaagcggttaaagatatcgcccgcgcctttgacatagcaagcggtacccaggcagacggaaattttgtattgccccttggggttgagcgtaaactgcgaataaaatgtcgcgacgccgtaaatttcctccagcgggatatctagcccgtctgaaatcatcttctgcacctcaatgggcagatagccgtagatttcctgcgcgccctgcaacacgggcatcaatgcgcctttctgccctttgtgagccgcaatcacctcgcggagcttcgcctcctgctccgccgtaccggtgaacgggaccactgttttggtgttcgccattcgtttgaaaacctccttcaaatctggttgcgcgcggaacagccgcgcgcggtcaacgtaattgttataattatatcagattcacaggagcgcgtctaggcattttcacgagaaagccattcatttcttacaaaaataccgttttagtagacaaacatttttgcaattttaacattttctttgtcgcctcattgtgactcatgcacaattaaattgaactattttccatcaattacaatttgtcccgtgctataaaaaaagcgcccccatcggggacgccttttttacgcggagtgtcagctctgcttaaattcggtccagatatcgttataaagatcggctgtctcaccgacatccatgataaattctgcgccggcaattgcctcatccgggatgacgagcgcctgattggacaggtacggcgtcgcggcggaattgcagctgatatagtaaatctgatcggtgatatgcgccgagcgttcgccgtcgagaataaagtccaaaaacgcgtgcgcattgtcggcgtgcggcgccttggccggaatgaaacaggaatcgatgccaaagccaagcccctccttggggaacacgacctcaaaattggggttctcgttgaggaccgtcagcacctgcgacgtaaacatataaccgacggatgtctctccgcttaacatcaggttatacggcgtgttgtaatcgagcgcgcgaatatttgggcgcagggtcagaagcttttccttggcctcgtcaagcacagccgggtccgtctcgttaaagctcttgcccatcgttttcagcgtgatgccgatgacattgcgcgcgtcgtccatcacaacgaccgaatcggcaagcgccggattccacagatcctcataaccggtgatctccaaatcgccgaccagctcgggattgtagatgatcagcggaatgcccgccgaatacgggacggtatattcgttgttttcatcatagaacttgccctggaaagccgggttgatatttttaaaattggggatcttcgacttatccagcttcatcagcaaatcctggctgcgcgcgatatcgatgatatagtcgctggccagcacaagatcatagtcgccgccctgctggattttcatgagcatctcctcattcgactggaacacgctgtaattgatcttgatgcctgtctgctccgtaaattcggcaagcacatcgtccgggaaatacgtggcccaggtgaagatgttgaggaccttctcatcagcctttttgccgcatgccgccagccctaaggccaataccgccgccatcagcagcgccagaattcgttttgtctttttcatttcttttctcctttggattattgatttatcataaaatgctcaggtacggaactgttgccattgctcgcgttcgataacctttaaatcgcagaagcgacacaacagctcaaccgcagtttccagcgtgtaatttgcctgcggcagctccgacagggcagtttttgccgcccactgttttttgcgttttttcatgaccttctttagccgccgctgatagatgccgacttctatatcggaaatccgcatcttcaggggaggccggttctgaaatacaaattcatattctatcgttgccggcgtccggtctgtcctgccctgcaaaatgtcggcgccattgattttggtatccgccacgcctgtccgatagatgaccttgaactcgtcgcgtgaaatccgtttcctgcgaaaaatggttttaattgtgacgctttgatcctccgggtgaaaaatcaacgtcccacgcccgttcctgatgccgtatgcatagaagctgcacgcaaagaagcctaaaagcctaaacatcaaaattgccaaaaccatcaggagcagcatgcctacgccccagagagcagggcggtgcgacaaataccggaactcataacgcctgggcagcggctcccccggttccagacgctgcgaaggcgcccacctgtacaaaaggactatgcaggcgatcgctgccgaaagcagcaggaatgcattcagaacaactgtcagcgtcggcgtttcctccatgaagaagatataggcaagcgtcgccagcacaaggagcataccggggtagaaaaagtccttttttaccagtcccataaagatggcaaaggcaataatgcctaataccagcacgtttgcccaaaccgtgttcgcaaaagaattccacatgttccaaaccctccattcaagttgatcccaactcaacgtccgtctgcttttgcgcggcgcagcctgtattcgcgcagcgcctgtcccgctgtccgcggcgcagccggctaaagttttttgccaggctttttttcaaaaaagcgggaacgggaactttttttaaaaaggccggagagcgcgacgaggagaaaaacggcgccgagcaggacggtgcacagggcgttgatttcaggggtgacgcccatgcgcagcatggagtaaatctcaagcggaagcgtgcttgtctgcgcgcccgtgacaaagaagctgatgaccacgtcgtccatgctcatggcgaaggcaagcagcgcgcccgacaggatcgcgggcgcgatcagcggcagcgtgatgtcgaaaaaggcgcgctgcgccgacgcgcccaggtcgcgcgcggcctccccgatcgacggatcgagcgccgacaggcgcgccttgacgttgataaagatgtacgggacgcagaaggtcgtatgcgcaagcaccagcgtgagcataccggcaggcaggcgcacaaatgtaaaaaacgacagatacgccatgccgaggatgatctccggcaccataatcgggatcatggacaggttttcaagcgcgccgcgcgccctgaaatggcggccggacagccccaccgccccgagcgtgccgagcaccgcggccgacgcgctgctgatcagcgccagctccaaactgttgaaaaacgcgttgatgagcgtttggttgtgaaagagctttccataccaggaaaatgtgaagcccgcccaatggaacagcttcgtatcgttaaacgaataagcgatgacaaccgcgatcggcaggtacaacagcagcagaatcagcacgacgtaaatcccggggaaccttgaacgctttttcacacgatcccctccagacttttttcgccggacaggcggcggtacccgccgattacgagcagggtcgccgccatcatcacaacggacagcgccgcgccaagcggccagttgcgcgcggtgagcagctcgtcgcggatcaggttgccgagcagcatggttttggagccgccgagcaggtcggaaataaagaacaacccgatcgatgggataaagaccagcacgcagccggccataatgcccgcacgcgtcatcgggacggtgatcgtccagaacgcgcgccagcggcccgcgccgaggtcgcgcgccgcctcgatgagcgcagggtccagcttggccaccgcgttgtaaaccgaaaggatcataaacggaatcagcgcatacaccataccgaccagcaccgcaccaaaattatacaacagcttgagcggagcgtcaatcagcccgagcgcagccagaagcgaattgacaacgccctgtccgcgcagcaggatcatccagccgtaaatacgcacaagcgaatttgtccaaaacggtacgatcacaagcatcagcgcgagcgaccgttttttcggcggcagcccggcggtaaaataggcgaacggatagccgatcaagagcgtcagcagcgtcgtcagcacagccagccacaggctgcgtccaaagacgcttaaataattcgggtcgagcagcttctgatagctctccagcgtaaacgccgcctcaacgccccaggtatcggcgcggcgcataaagctcatgcacaggatatagatcagcggcaccgccacgaacaccgccgtccacaggataaacggcgcggccgccagcgggaaccggcgtcttttgttcatggatgaccgcccctttccacgatcacggcacaagccggcttccaatggatgcgcaccgtttcgcccacctcggcccgatcgcctccgccgcccatgccgctgacggtcaattcctgaccgtcagccaagcgcagtgttgtgcgcagcatcccgcccgtatagctgtgcgcctgtacgacgcccgtcaaatcgaagccgtaacggctctcctcaccgaagcggatgcgttcggtgcgcacggagatcgtcacgcgctcgcccggcgtgccgtcgccggccgctttgattacgccgccggcaaacgccagcgtcagcgcgcctgtctcgtcgcggccggtgatggttgcagtaaagatattgctctgcccgataaattccgcggcgaaacgcgtctgcgggcgctcatagatatcgtcgggcgtgccgagctgaaggatgcgcccctcgttcatgatgccgatgcggtcgctcatattgagggcttcctcctggtcgtgcgtaatgtagataaatgtgatgcccaaatttttctgaagcgttttcaactccgtctgcatctggcggcgaagctgcaaatcgagcgcgccgagcggctcgtcgagcagcagcacggccggatcgttgacaattgcacgcgcaatggctacgcgctggcgctgcccgcctgaaagctgcgacggcatacgcgcgccgtagcccggaagctgcacaagcgaaagcatctcgtcgacgcggcggcggatttcatcctttggcgtctttttcagccgcaggccatatccaatgttgcgcgcgacgttcatatgtgggaacagcgcgtagctttgaaacaccgtgttgacattgcgccggttcggctcccagtcggttacgtcgctgccctggagcagcacgcggccgccgtcgggcgcttcaagccccgcaataatgcgcagcgtcgtcgttttgccgcagccggacggcccgagcagcgtcaaaaattcgcccgcctgtacgtcgaggctcacgccggtcagcgcctcggtcgttccaaaggtcttgtgaacgtcgcgcagcgataaaattagttcctccatgctatctcctccctgggatctgtgtccgggtcccgtccgccaaagcgcccggttcttctgttcagcggataatcaggcccagcagcttcgccaggccgcaagcctgttcggcggtgacaaccgcgccccgcaggctcggcggatcgacgatcaggccgtcgatttggcaggttgtcaaatccatcccctcaagcggcgttttaaacagctccgcggccatgagcgagcacgcttcaaacgtcagggcgcgccaacgcagctcgtgaaacgcggcgccggcacagtcgcaccgctcaaagcgcgtatcccggatctgcgcgcgcgaaaactgcgcataaccgcaggcgcacccgctaaacagcgcgtccgaaagcgcagcctcgccgaaatccgcgccggtcaggcggcagtcctcaaataaggcgcgcgtcatggaacagccgtgcagatcggcgttcgacaaatcgcagcgcaaaaacgacacatctgtaaaaaacgacctggccagcgatgcaccggaaaaacggacgccctcgaaccgcacgcgcgtaaacgcgcccttctccagatgtgcgccagtcaaaccgcaccggcgcagcgccgtgtcggcgaaacgcgcctccggcagctccaaagcgtcgagcgaaacgccctccagggcacagcccgtacattcgcagtcaggctgtccatccggcaaaccgcacgcctgcgtgatcagcagcccctcagccggcgcgccgtgcgcccaaagcccgcgcagcgcgccgggctgcgccacggacagcgccggcatacgcggcggctcgggccgccgcggcccgcgcgccttcggcgcgctcaccgcgtcaccacgcggccggcgcgcacgccggttatccggtcatgttcgacagccgccgcgccgccgacaaacacataatcaaaaccgcttgcaaacacagacgggttttcatatgaggcgtccgccgccagacgcccaagttcaaatacgttgatatcggcgtcgtatcccttccggagcagtcccttgccgcgcagcccgagcaccgaagcgggacgggcggtcatcttgtggacagcctgctccagcgtgagcaccggctccctgcgcacataatcgatcagcacctttgggaacgccgcgtacagacgcggatgcggcgtcccgccggacggatagaccgcgtcggaaatcacattgctgtacggataccgcagcaccgcgcggatatcctcctcggaagtgataaaatcgaccatcgaaatccggcactcctcctcggcaagcaggcggcaggcgcaggcgcatgggtcctcgccgcgcgccgccgcgatctttgccacgctcatgccggtatatgcctggttctccggccgtgtaaacgtggtgcagcggatattctcccagccgatcagattcacaaggttttcaaaccggccggaaggttttgcaaaaatcccccgcagctcctccacctttgccgggtcgcgcaggcggcgcgtgatcgcgggcgcgccgccgtcgagaaaccacggcggcaaaatctgcaaaagctgcgtcgaaccggccgtatacggatagacgtcacaatcggcgcgcaggccgctttcacgcgcctcatcaagcatttttagcgcacgtgtcatcccatgcccccaattgcgccgcccgatgcatttgaaatggctgacgtgcagcggcgcttcgagccgccttgcaatatcgatcacctcgtcaagcgactgatggaacgtgtcgccctcgccgcgcacatgcgtgaccagcggcacgccggccccccgcacaggcgcgagcacctgtgcaaagccgtcggcgtcgtagcagtattccggcgcgtagacgatgcccatcgacacgccgagcgcgccgctggccagcgcgtcctccagcagaccgcgcgcagcggcaagctcgtccggcgtcaggacgcccggcgcatagccgcgcaccgcggcgcgtaccgtcccgtttcccaccagcatcccgacattgagcggcagcggcgtttggcgcacaagcgccagatactccgcaaacgtctcaaacggcgcgggcgcgtttacatcaccgatcaccggctgcaaaaacgcatggatttcatcgcgccgcgcggccgggcacggcacggccgacagcccgcagttgccgttgacgaccgtcgtcagaccctgacgcaattcagcctctccaaagcccggggagaacagccgcacatcggcatggcggtgaatatcgataaaccccggcgtcacaagccgccccgcagcgtcgatcacgcgcgccgcgccgctctcaacgcgcggcgcgacagccgcaattttgccgtccaagaccgccacatcggccggtacggccgcatcgccgctcccatcgacgaccgtcccgccgcggatcaaaagatcatacacgttccgtttccccccttcccgccccgtccggggcgcagttgaccagatacacgccgccgcagacgagcgccagcgccgccaggttttttatgctgaaaaaccgttcgccaagcacaacagccgaacacagcgcgccgaacaccggcgtcagcgaattgtagatgctgattttggcgaccgggttgtatttgagcaaaagcgtccagattgtaaacgccatggccgacagcacggcaagatatccgagcagcagccacgcagccccggacggcgggaccgcgcgcccgcccatcgcagcgccgcccgccagcaaaagcgcgccgccgccgagcagctgccagccggtgacggccgccgggtccaggccgcgcgccgcacggccgctgatgacgccgccgaacgcgaacgaagccgcggccagcagcatcagcccgtcgccgcgccatgaaaagcctcccatgccgcctgcgccgaggtttacgagcacaacgcccgaaaaaccgacggcgcagcctgcggcgcggcgcgcgctcattcgctccccggtacacagaaaatgcgccaggattacgccgataaacgcggcgcttgaatcgatgatcgcgcctttcgtgccggtggtatgcgccataccggcataaaagaacaggtattgcagcgttgtctgcacaagcgcaagcagcgccacgccgccccaccggccgcgcgggatcgacggcggccgccctgtaaatacagccgcgcagacaagcgtcagcgcccccgcgagcacaaaccgctcccccgcgaaggccatgcgcccggccatatcgtccggcgcgagcaaaaacagcgtgtacccgcgcttgacggccggaaacgccgtcccccacaaaaagacggcgcacaccgcgagcagatgcgtcagcgggccgccgcgcagcgcgcgcggcccgtccacggcgctcacgcgccgcactggcgcgccaggcgcagaaaatcgtcggcaaactgttcgacagccgcttccggcgtcgcccaggatgtgacgaaacgcatcgcgcaatgcgtttcgtcgacgcgcatctgaagctcaaacctgtaatccgcagcccgaagcgcctcgatcagccggtccggcagcacggcaaactgttggtttgtcagggaatcgctcatcataggatagtcgttttccgtaaacaggtcgcgcaggcggcgtcccatcgcgttggcgtgcgcgccaagctccgtatacaggttgtccgccagcaacgcctcaaactgaaggccaagcaggcggccttttgccagcataccgccgcgctgcttgatgtgatagcgaaaatccggcttgagcgcgtcgtttgtgatgacgaccgcctcgccgaacagcgcgccgcattttgtcccgccgattgtaaacacatcgcacagccgcgccagatcaggcagcgtcacgccgctgcgcccatcggccagcgccatcgccagacgcgcgccgtccaaatacagccaaagcccgttggcgcggcaaaaagcggaaagctcctcgagctgcccgagcgtatacgttgtgccgatctcggtcgtatccgatatgtaaaccatctttggctggaccatatgctcgtcaggatgcgcggcaagcgcctcggccgccgcctttggggacaggcgcccgtcaagtgaagcaaggccgatcgctttgtgtcccgtggcttcaattgcgcctgtttcatgcacgcagatatggcccgtatgcgcggccagcaccgcctgatgcgggcgaagcgacgcagcgatcacggtcatattcgcctgggtgcctcccacaagaaaatgcacatcggctttgggcgcgttacagagcgtccgcacccgctcgcgggcgcgcgcgcagtaatcgtcggtaccgtagccgtcggtctgttcagcgtttgtacgcgtgagcgcctcaagcacccgcggatgcgcgccctcgctgtaatcatttttgaagctgtaccccattgtaaaaagacacttccccatcgtatactcaaaagatacattttattatagtacgattttcccgataacacaacctttttctggagaaccagacctggcgggctgttttggcgtatagcaaatgtaaaaagtttataaagataacggcggacgattgttttttacaagcggcagggatacaataaacaggaaacagatgaatgaaatggagacgacctgatgattacttttgagcagatctttgaaaacgagcagatcaaaacatacatacgcaaggccgacgacgcgctgcgggtgcttggcttcacagagcacagcttcgcgcatgtcggcaaggtggcgcggcaggcgcgcgatattctgctgacgctcggatatccggagcgtaccgccgaactggcgcagatcgccggctatctgcacgacataggcaatgtgatcaaccgcgtcgatcatgcgcaaagcggcgccgtcatggcgtttcgcctgttggacaacatgggcgcggacgccgaggacattgcaaccattatcagcgcgatcggcaaccacgacgagggtacggccgtggcggtggatgctgtggccgccgcgctgattctggcggacaagacagatgtgcgccgcacacgcgtgcgcaaccgcgatatggcaacctttgatatccatgaccgtgtcaactacgctgttgaagaatcctccacggcaatctccggcgacaaaaaatcgattacactccaaatccgcattgatacggagctttcctcagtcatggattatttcgaaattttcctcgaccgtatgctgctctgccgcaaggcggccgaacgcctgggccttaaattccgcctggttatcaacggccagaccgtgctctgaagcttaaacagatccgccttcctttgggccgcaccatgcgcaccgcttcaggtcgacacggccgtctgcaaaaaacgggacgccctccgcttcgagcaaatcccgctgcgctcccggtccgccgaacgcgaacgccggcgcgagccggccctcgcggttgacgacgcggtggcatgggatttccgcccccggcgaggggttgcgccgcaaagcccagccaaccgcgcgcgacgcgcgcggatttccgcacagcagggcgatttggccataggtggcgacgcggccgcgcggaatcagccggacagccgcgtaaacgctttcatcaaacgtcatgagggcatccatccttttttaaaaattcagatcagccccatgcccaaccggcatggagctgatctttttttgtctgccgaatgctttagaacctgtattcacagccgcaaaacgccgtccatctatccgcggcagatacctcgctgcctgcggcgcagcctgtaaaagtaccggaacccgccccactgttcgcggcgcagcctgtaaaaatccggaacccaccccactgttcgcggcgcagccgactaaagttttttggcttacctttttttcaaaaaaggtaaggttcaaaaaagcgggggctggagcgggaggcagacttccgtcacccaattgtcaggattttgatccatcgcggggctgacatgatagatcgagaacatgcagccgccgatctgacggccgttcgcttcgatccatgcgccgagcgccgcgcaggcggctgaggtttgatcatggcggccatgcaccattgtcgacgccgcttcaaccgccgcaagctcacagtaaagcggatgggacgggtctgccgcatccgaaaccatacatacctgtacatcgacatccgactcgcggtagccttcgtcgaaatataccgatacagcctgatacgtcccgtccgggacctgttcgcccagacgccgccaaagaatcccttcatcctcataacgcgggatgatatcccgcaggcagtacgcctttctgacagaaaatttcttgcattcaaccggataattcataaacatttcatcctttcccacctgttcgatggccgatgcaagcagcacggcgcgggcctcgagcacccgcgcctgcgcctgcgtgcgggaaaggctttgcatcagatagcgccgcagactgtccgcgtcgccataccgggtcagaatttcggacgtttccgccaggccaaagcccagcgcccgcaaggcgcggatacgtccggctgtacaaagctgcgccgcctcataatagcggtatcccgaatccgggtcgatataccccgggcgcagcaggccaagtttatcgtaatggcgcagcatacggatactgatcatcgccagccgggaaaattcgccgatcctgaacatgcaaagccgcccctttccttcttacatctttgcgcgcaacgtaagcatacactatgacacaatgttagagtcaaggggcaataaaatcaaaatgcaactaaccatccggcagtctggacggcaagcttatgcatcctttatgatcatgaccggaatcggcgggcaattcggacggttggcaaactgcgccgtgatcacagtaaaagcacggtgatcgattgttttaaaatattccatcagcgcgtcgcgctcgtcaaagcccgtgtcgcgtccatagtagatacataaactcatgacgccgcgcggctttaacagcccaaggccggcttcgaccgcggcgatgctgctatcggcgcgcgtgttgattgaatgatcgccgccgggcagccatccgaaattaaatgtgatacagctcactgattccggcgcagcatatgcagccatattggcgtggctgtcgagcacagcgcgtccaattcccgcaaaaccgcgcgtatgcagcagttcggttgtgctgtcaattgcctcctgctgaatatcaaaagcaagcacgcgcccagacccgccgacaagcgaacagagaaaagccgtatcgtgtccgcggcccgcggtcgcgtcgatgcagaaatccccggactttacatgccgcgcgatgaaatcatgcgccacctgaagcgcgctgaatttaccggccatcatacccctccctcatcgcctggaatatgtccgccgcttctagccatgcgtctattcccaggttttccatatctcgggacagtacccgaccgtcgcctgacggccattgcgtacaatcggcgtcttgagcacggacggcatctccagcagcttttcgatcaccgcttcctcgctggccagataggcgacataggaacgaccgtaatcctttgatttctcgtcgatcagcggctttaacccgccgaccgcgcggcgcacattgtcaagctcgccgcggctcataccgtagcgcggcaggtcgatgctttggaatttgacgccgcgttccttaaaataccgctcggccttctttgtatcaaagcatttcgacttcccataaatttgtatattcatatcagaccatccatttccatactgcgcgcggggctggcattttcgccggaacttttttatgaaggccggtgctttggcgcgcggcctgtacgcgggccgctcactgccggacgctgcgcttgcccggccggctattcggggctttccggcgctatagcgccgggcgcggacaagccgcggcagcaccccttttcgcgcctcacgggacaggggcgggccgcccctgccgcccctgtcccatggacccaaccccggggcaggcgcagcctgtattcgcgcagcgactgtcccactgttcgcggcgcagcctgtatcaacgcagcgcccgccccactgttcgcggcgcagccgactaaagttttttgccgagctttttttcaaaaaagcgggggcacagccgactaaaattttcgccaaggccttttttcaaaaaggccggagcaaaatccacgccagccgcgcggcgtctgtcatggattttgctgggggcgggcggtgcgtctaaacaggctcttgcggcctgcgggccgcgctttttatgagggctgcggcccggggtaaagggcgctgccctcggcgggagccaaagcccgcgaagggctttggctcccgccttcacccgccgccttttgaaaaaggcgggcgaaaacttttgatcgccgcggcgtgaaatccgattatgcagcgccgccccgttattcgcggcacagcctatctaaccaccgacggctgtcccactgttcgcggcgcagccgattaaagttttttggcttacctttttttcaaaaaaggtaagtttcaaaaaagcgggaaagctgttcgcgcgcgccggtcagcgtgccctgcaccaagccggattttccgccgccgcggccgtcaaacgtctcgttgagcgcagcgccaagcgggcgcacatccgtctgttcgctgccgaccgcatagctccagcggtccccttcgccgccagccagcacggcggccacgccgcatcggctggtaagcgccatacagagatgacgcagatcggccggctccatcgcctcctcgaataaaacggcgcagcgcgcgccctgctcaacttctttcgcgcggtatgcgaaaagctgcctgcgcagcgcggaaagccgctgtctgagcgcctcattctcccgctgcatacgcgcggccgcggcggcaacttcgccgggctttacggacagaagcgccgaaatcgcatgaaccgacgcgttcttcgcttcatagtcctcgagcgcgcggccgccgcagcagagccatacgcgcgtaccgcccttatatcgctgcgctgacagcagcttgatcatgcccacctcgccggtgcgcgccgtatgcgtcccgcagcaggcgcagacatcggcgcctggtacggttacgatacgcactgccccggaaattgcctttttgcttctgtaggcgagcgccgccaacgctccggcgtccggatattcaatccgcaccggaacatcgcgccagaccgtctcgtttgcaagccgttcggcgcgcagcaatttatcccatgaaagctcgcggctgagatcgatcgttacggcgtcgcgccccatatgaaacccaacgttgtcaacaccgtacaagctatgcagcagccctgaaaggatgtgctccccggtatggtgctgcatacgtgaaaagcgggccggccaatcgatctggccgtgcaccgctgtccccacggcgagcggcccgtcggttatatggcggatctccccgtccggcccatcatgggtatcgcatacgcgcacgccgccaagcgcgcccgtatcgccgggctggccgccgccttcgggataaaacgcggtccgatccagcgtgacggaccatgcgtcaacgaccatttcacagccggttacaaccgcgtcgaacgcgtctatataggcgtcctcataaaacaggcggcgcgtcatgctttgagccgctcccactcggcgggcttaaagcccgcgagcacaaaatcgtctccgaccaccagcggacgcttcaccagcatcccatccgtcgcaagcagtgcgaactgctcctcgtcgctcatatgggggagcttgtcctttaattccagcgccttataacgaaggccgctggtattgaaaaaacgcttgagcggcagcccggaacgctgcgcccaatcgcgcagttcctcggcggacggattttgttcaacaatatggcgcgccgtataggccacgccgttttcatcgagccacttttttgccttttgacaggtgctgcacttggggtattccaaaaacaaaaccatctgccgttcctccttattcgtcatccaatatcgcctgcacgcggccgacgcggccatcctccagcatcaccttgataccatgcggatgcgtgcggctgtttgtcaaaatccgggacacacggccgcgcgtcagcgccccggccggctgatccttttttaaaacaatatccacaagcgcgccgggttttatatcggcgcggtttctgccatccatcatacgccctccgatgcgctgtccgcacagacattctcgcgcgcaacatcgagtataaacggcttaaaccgttctatgcgctccatcagcgcatccaacccataatcaagcttatactccatctcctcatggtaaagaggaagcgccgtgtagagattgatacggacgccgtcacgcgtctcaagcggaccggcaagcgccggctgatcgatcaggagcgtaccgctcagggccgtattttcggcgtaaggtaaataatcggctgtattgggaatagtgtgtcctgcgccaaaccaggtgtcatattcatgcggaaagcgtgcgagaaacttgagcagacgcgcaggccagcaaccttcccgcgcgccgccgccgagcgcctgcatgtcccaatcgccgggcagcagcatcatcagctccgcccgctccagttttttccgcccttgaacttcacgcggcaccgacatgggcaaatcgctcataccagtcgtataaaggacaaaatatccgccggcagcatccggctccatcacatgcaggtcaatatggataaaatccgacatcaattcatgcagcacatgaacctgccgccctgaaaaagctctgtccatatgcgcttcgatttcctcacagtaaagcgtcggcgcgggcggccgccatcctgtttcacgcgcatcctcatagcggtaaaccggcgtgccgtccgccgtatatgtttccggatcgacacgccggccggcgcgccggcgtttttcatttgcggatttgttaaacaacgccatatcatcttcctcccaacgtcgcaaatacttgcaatgcaccacgccatggaccttccatgacgcggacataccaaatggatgtccggccgcaccgttcaggtgcatttactagaatgcgtccgcccttggagtcggagcaatttgaaaaggcaggcggcatgagcgcgctctgacttttcaaaaaatcggagcaagctttcgatcgcttgctccgatgttcagcaatcggccgaaatcactatgcgcagggcgcaggcgctttctttttgatatgaaaaaaagcctggagcacaaattggctccaggcccttgcctggtggcggagatgaagggatttgaacccttgcgccggtttcccgacctactcccttagcaggggagccccttcaccaacttgggtacatctccaaaatcagtggcaatataaatatcataaacacgaaaagctgctggcggagagagtgggattcgaacccacggcccttttggggtcactggttttcaagaccagctccttaaaccgctcggacatctctccatatgtcacgctgtttataataccatatttaaccggacaagtcaagcccttcccccagcgtgcagccttcattttttgcggcgttttttgtgcgcaggctttttgcggacagaaaatccaaacgtaccgatgcgccgtccaagctcaaaataggacccgtgcgcataagccgccaagccggcgcgctccaggcataagcggccatccgcatcgatcagggacggatcaaccgctacagccatgatccgcgcaagaaacatatcatgcgagccgagccggagcacctgctcaacggcgcattcgatcgacagcgggctttgggcaagcgagggtgcctccacagccgacgacgcctgcgcggtcaacccgcacgcctcgaatttatcaacatcccggcctgaccgcacgccgcagaagtcggctgcacacacaagctgcgccgtggtcagattgaccacgtatgatccgttctgttcaattaaactatgcgagtagcgctgcgggcgcacagatacataagtcatcgcgggatgggtgcagacaatgccggtccaagctgcggtaaaaacgtttggcgcttccagcgtgccgcaggtgacaagcgccggcggcacaggcgccagcattgcgcctggcttccagatggttttcaaatagcttcccccattttggccagatcattcccggatgcgctgtaaactgcacatccggctgtttcctacagtataccatgccggccgcgccgattcaaccgtatggcatatgtatggacctgcccggcgcaaatacgccgggcagatccatgtgggaaaaaggagggatgtcggccaatctcagaacagggcttttttctccgcaggcgttgtgctggcaatcagccggccgcggttataggaataaagcacctcgctcttttgattgagcgcattgtagaaattgttgttgttgagcaggataaagcttgccggatttccttcccggattccgtacttatcgcccagatgcagcgtgcgggcggcattgtaggtacagaatttgtacgaatccatgatctcctgatagcccatcatctggcagacatgcaatcccatatggattacatcccgcatgttgccgtcgcccagcggataccatgggtcaaagatatcgtcatgcccaaaggaaacattgttgccgttggccaacagctccttgacgcgcgtgacgccgcggcgtttgggataggtgtcaaagcgtccctgcaaatgcgtgttgacaagcggattgcagacaaaattgatatcgctcatgccaagcaaacggaacagcttgccgcagtaggcattgttataactgtgcatcgccgttgtatggctggctgtcaccatgtctttcataccgctttccaaggcgcggcacgcgagcacctcaagcccttttgactgttcatcgtcgatttcatcgcagtgcacgtcgaccaggcgtccatacttttcggcgatcttcatgcagaaattgaccgactcaaccgcatattcgcgtgtaaattcgaaatgcgggatcgctcccacacaatccgctcccatcttgacggcattttccacaagctgctccccgtttgggtagctctggatgccttcctgcggaaacgcgacgatctggatatggacaagatcctttaattcatccttcagctccagcattccctccatcgcaatgagcgtcggatcagtgacgtcgacatgcgtgcggatatgctgcacgccgttagccgcatacatgcgcacggcgcggcccgcgcggtccttcacatcctgctttgaaagcttctgtttgcgtttgctccagcactcgatcccctcaaacagtgtgcccgacagattccagacaggatctccggcggtcaggcatgtatcgagatggacatggctttcaataaacggcggcagagccagcagccccgtcgcatcgacaacctcctcgcccgcttccggcgtcaggccggccgcgatctcgctgaaaacgccgtctctgatgcggatatccttcgtttcctgcgcattctcgatgtatacatttttaatcagcatacgactcgtcctttcttccatgcggatacaaattcttactttttacgggtcgccatatcccagatcaggaaaatcacagcggcaacgacaagagaattgaccggcttgatgccccaagtcacaaagatgccgacaagcgcgccgccaattaccgccaaaataccgccgatattgactgccgccgccttgtagccctcgctgtagtaatcctccttatgcaggaaataatgcaggatgaccaccgcgccgaccggcgggatcatgccggaaagcaggtttaaaaatccgacaaagttgttgtaaagccagacggccgtaaccgtgccgaccgcgccgccgacaagtaccatcggcttcatcggcacacgcgcgatattcgacacgccaaggcccgctgtgtaaagcgcgttgttattcgtggtccagatattcagcccgagcgtaacagccgccgggattgccagcccctggagaatcaggatatcaaagatatccgccacgccggtgaccgcgcctccgaccgcgccgaaaatcatcatgatggaattgcctacaaagaaggcgatgaccgtcgcccatacggcaattttcgcagtcttggaaaagcgcgtgaagttcggagtggcagtacctcccgaaataaacgaacccacaacgatcgcgataccggccgccagggtcagtggattttcgggatgctccgcaaagacatttgtaaagccgccgacctggccgactccccacgatacggaatagacgccgaggatggcgatcaggggaacggcaatggatccgagcacagcgagcgccttgatgccgatgtaagctgtgacggtcatgataacgccggtgatgacaatcagcagccagacgggcactttgccgccggtcaggccggacaccgggatcgcaaacatcgcaacacccacgccgaaccagccgatctgtgtgaagctgatgagcgccgagggcagcaacgagcctttatcaccgaaggaacggtgcgcgagcaggtcaagcgtcagacctgtcttttggccgatgtaacctaaaatgccgcagtaaacgcccaaaaacgcgttgccgataatcatggccgaaagaaagcccgtcaggttcataccgatgccgaggtttcctcccgccgtcatgctcggcgtaaagaatgtgaagccgacaagcaccaccattgcggcccaaaggccctgtgtcttttttgcagaggggacggcgctcaacgagtattcgctgtcttccgcctgtggtttccgtttggtttgctcgctcataatgttcctccctttcaatccggatttgcacgccatgcctcttggccggcacctcaaacacgttatgaaaatagtttcataacattgtctttactataccatgatctgccgctatttaccagcggctaaatagccaaaaataggccgttttttccgtcataacgcccgattccgtttgtgtgattcccccggctcattctttgtaaccgctttcattacaaattttaaccgttgtctttttatacaattttatatttgatacatgtccaatcctcttgcattttgcatgttatcttggtaatctatatacagaatgatagggacgatcgattgcggcgtttgtgttgtatgtaaggaggaggctgcgtgaatatcaaggaaattgcccggcaggctcaggtgtccgtcgccactgtttcacgcgtgctcaatcacccggagcttgtgcagcctgaaacgcgcgcacacattctggaggtcatggcccggcacaattacaccccaaactggtttgctcgccggctcaacctcgcgcgcacaaataccatcgctctgcttgtgccaaacattgagggcggtatcaatcagaaggtggtcgcgggcgttgaatcggtcgcgacaaaaaaagggagcaccgtgcttttatgcagcacccatggccgccccgaggaggaggaccggctgctgcgcatggtgtttgaccggcgggtcgacggtgtgatctgctcctcgtccaacctgacgcaggcgcggctgaatgaatgcggcctgggcagcagcgcctttgtgttgatcgggcagggcgacggggagatgaccgcctgctatatcaactttgagggcattgcttataagatgacgcagcatctgctcggtttgggacggcggcgcatcgacctgctgctcgacgaaacaggacacagcagaaacgatccgatcatctccggataccggcgcgctctgctggacgccgatgtgcagcagggccatatccacatggcggccggcggcctgcgcggcggctatttggctgcgcggcggctgtttgcgacggaaacgctgcccgatgccatctttgccggcagcgacgatctcgccttcggcgtcatgaaggccgcgcgtgacgacggcgtcgatatccctgcgcggctggctgtcgtgggatttgacgattcgcttctgtgcgacctcgtcacgccggaactgaccagcatcgagcagccctccaaacggctgggaatggtcgccgcgcggcttttgttcgatttgatcgaggacgcgcagattgccgagactgtcccgcaggaggttgttttacagcctaagctgaaaatccgccgctcctgtggaaacaaaaaatatattcatgaattatttgattagatgtgtcaaaaacatattttctgttttatgcaagccgcctgcaattcacacagaatcgcgcctccgggctgttttggggcctcggattcttttgggcctggacgtgtatgttctgttttccaaaggagggggaagggtatgtccttatccgtgcaatttcttggcatgacgttaaaaaatccggtgattgtggccgccggaccctggtcatgcgacgcagccgccatccagaaatcgatcgacgcgggcgcggctgccgtcgtcacggaaacaatcacgctggaggcgagcacgcgcgtctgtccgcgcctctaccagcatggcggaagtttgttcaacaccatgctgtattccaccatcgatcttgaacagtgggaacaggaaatcaagcgcatagataagcgcgacagcatcctgatctgttcggtctggggggccaccgaatcagaaaccgcctatatcgccaagaaggtggaacgtctcggcgcggatgcaatcgagttaagcatcagcgcgcccatcgggacacggagcacgcgtttcgggcgctcccaggaacaaatcggcggctatgtgcgcgccgttgtcgaggcggtcgacctgcctgtgatggttaagctgtcctatgacgcaagcgcgaacgttgcgttcgtacatgcggtcgagcaggcgggcgcgcaggcgatcagcgccatcgacagcctcaaggggcttgccggcgtcgatatagaacacggcatgccgctgatgcccacctgcggcggttattccggtgcaaacctgcgtccagtcgcacttgcaacgaccgccacgctcgcacaattgacgcgctgcgagatctgtgggatcggcgggatcgaatcgtacgaacacgttttggaatatgtgatgctcggcgccaacgcggtgcagcttgcttccacagtgctgctcgccggctatgaacgcatcacgcgaatcgtcagcgatctgcgcgcctggaccgacgcccacaatacaaccctggcagcgcagcacggccgcgccctgcaaaagctgattccctttgaggatatccctgctcagcagcttgtctgtgcctttcaaaacccctgcacgcgcatcgactgcggtctgtgcgccgcaagctgcctggggggcggcatccgattgagcagcgacgggttctataccgccgaccccgacgcctgcaccggctgcggcctgtgcgccgcccgctgccctgaacaccgtatccggctcgcgtggcgctaatgcgcctgtgcgcaggctgtacatctctgcatgaaccttttttgttttccactcgcaataaaatgtatacatatgcctacggcctgttgaggacagcggcagacagaaagccgtccgcctgtaaaggcggacggctttccgtctgctcatcagcagtttgccatcttgtaaacggcataaatatcctcgacgccgagcacgcggaatgttccgattgtgcgcttgccgtaaaaagtacaccgctcggccagctcgcgcaggaccgcgtcgtcctgcacgccgatgccaagctctgtaaagcaggtcggcattccaagcgaccggaaataatcgacagttgcctcaatcgcagcttgtgctgttttgatctcggacgcaccgctgattccccacacgctgcggccataccgcgcgaaccgggccgggtttgtatccatacaatagcgcgcccacggtccccacatcgtcgacaggctcgcgccatgcgcaacatcaaacttggcggaaagctcgtgtccaaactggtgcggcgcgaaatccttcggcgcgccaagccctgtcaggtcattgtgggacaggctgccggcccacatcaattcgctcatcgcgtgatagtcgtgcgtatccttcacagcgatacgtccgtttcggatcgtcacgcgcagcagcgcctcggcgatttcatcggtcagctcgttgccggcgaccggattaaagtaccgatcgagcgtatgcatcatgatatcgaccacgccgcacgccacctggtataccggaagggtaaaggtcagctccggattcataactgcaaatctggggcgcaccacatcaagcccaaggccgcgcttgacgccggtttcctcatcggtaagcacggacgaattgctcatttcgctgccggccgccggaatggtcagcaccgcgccgaccggcgtgcagcccgcgggttttctcccctttgtccagaaatcccagagatcgacgcccgggttggccagcgcaagcccgacggccttggcggtgtcgatgacgctgccgcctccgaccgccaggataaaatccgcgccgaaagcggcggctttttcggccgcatggcgagcgaatgaaagatatgggttgggatgcaccccgccgagcgtttcacacacaagcccgttttcacgcaggttttgttcaatcgtaccgatcaggccgcttttaacggcgctgccgccgccatagagcaaaaaaacgcgtgtgccgccgcattccttcaccagtccggcgcagcgcatttgggcgtcctttccaaagacaacctttgtcggagcataataatcaaaattgagcatcgtttgccctccctgtcaaatttctatcttatcgtatggggcgcggactgtattttcgagtcagcgccgccaggttgacggtgcgaacagcgcgagcacaggaaaaatttccagcctgccgatcagcatatcggctgtcagaatgatcttgctgaaatcagaataaaccgaaaaattgctcatgggaccgaccatcccaagcccggggccgatattattcaggcaggagagcacagctgtcaaattcgtttccagagacaattcatcgagcgatacaagcagcgccgacgccgccagtacgatcatatagacggacatataggcgtttaccgcatggacggtgtcattggacaggacatggccgtccatgcgcgccagcttgacagaacgcggatgaaaaagctgcgaaatttcctttttggcagatttaaacaggataatcagacgcgccgtcttgataccgccgcccgtcgaaccggcacaggcgcccaaaatcatcagcaccgtcaataccgcgcgcgaaaattccggccaaaggttgaaatcaattgtggaaaagccggtcgtcgtcatcacggatgaaacctgaaacgctgcgtgatgcagcgcctgtcccgcgtcgccgccaaacattggaaggatgttccaggtgatcacggcgatggccgccagcataatgccgaaatagacgcgcacctcctcattgaacagcgccttggaaaacgcgccggtaagaatcaggtaataaacggaaaaattgacgccaaacagcgccataaaaactgtcgtgactgtctggatataggggctgtagccggccaggctgtcatttttgatgccgaatccgccagtacccgccgtaccgaacgacgtggttacagcgtcgaacagcggcataccgccggccagcaacagaacaatctgaatcgctgtcatgacgacatagatgccataaagaatcttggccgtctgatgcatacgcggaacaagcttatcgacctggggaccggggctttcagcgcgcagcagatgcagcgcgtcgccgccattgtggcgcgcgggggcgaccgccagcagaaagaccagcacccccatgccgccgacccaatgtgtaaagctgcgccaataaagcaggctttgaggcagcgcctccacgtccgtcagaatactcgagcctgtcgttgtaaagccggacaccgtttcgaacacacagtcgatgtagctggggatcgcaccgctggcgtaaaacgggattgcgccaaacagcgaaacgaccagccatacaaggccgacggtcacaaagccctcgcgcgcatccataccgcgcgggctgccgccgcgcgtccaccaggccgccacggccgcaagcaatgcgacggcgatcagaaagccgcgcaccgccagccattcgccgcagtagaccgcgattgccagcggcggcagcatgaacagggcttccacgatcatgatgcgccccatcagatttaagacgatcctgtaattcatagcgcgccgccctcccgcgcgccggctgccggcacggcgccgctctcgtcaaagatcgcgttcaggctggttatcatgcggtcagccgtcgtcacaacgaccaaggaatccccctcctcgatcgtatcgcttccctgcggaataatgatgcggttgccgcggttgatgcaggcgatgagaatattgggcttgaggcggatcttttcgagcgtctcgcccagatgaagcgtggcggcgtccgccaaaaattccatcgcctcaacctttccatcgacgatccgatgcagagccaacatagcgcccgtcgtgttctgcatggcgcgcacatagcgcacaatgtcgtttgcacagagcagcttggggctgataacgcagtcgatccccttgccgcggataacctcactgtattcggtgcggttaattttggtaacaaccttgggcaccttcaaataattggcgtacatcgaaataagcaaattttcctcgtcgatgtttgtaagcgttacaaccgcgtcggtgcgttcgataccctctgcgcgcagcaccgcctgattcgaaccgtcggcatggagaatatcagcctgcggaagcagctccgcgagctgctcgcagcgcgctgggtccgtttcaatgagctttacatggatgcccgcctcggtcagcaggcgcgtcagataatacgcaatacggctgccgccgaccaagatagcgtttttgatcttgtgctgatagagccccagatgcttgatcagagctgtcaaatcctgcgtggaagccgtcacaaacagcttgtctcccttttgcagcttaaagcgtccgtccggaatatgtacactctcgccgcgttccaccgcgcagacaagcaccttgacgcgtgcaatcctgtaaagctccgacatacgcttgccgttgaggatgctgccctcgcgcagctcgatttcgacaatttcaacacgcccctttgcaaaggaatcgcggcgcagaaacgtcggaaactgaagcagcctgaaaatctcccgcgcggccgctcgttccggattgatcgtcatactcagccccaattcgtcctttaaaaagagaagctgctctgcatattcgggatttcgcatccgggcgatcgtgtgctcgcagccaagcttgcgggcgatgatgcagcagagcacgttgatttcatccgcacttgtcgccgcgatcagcagatcgctgcttccgacatccgcggtcaactgtgtctgtaagctcgcgccgttgccgtgtacaaccatcacgtcgaaggtttccgcgagggcggccagaactgtccggttgctgtcgatcacgacaatgtcgtgcccttcctcggagagctgctctgtcagcgtatagccaaccttgccgtcccccacaattacgattttcatgttctttcttctccatcccacggcttggcgccgcgttccattcaaaggcttttcagcctcactctatcacaaatcgcacagcatggcaagcagtatatgaaacgcgccggcgcaggaccggcgcgtttttatttggagcctgaattcacagccgccaaacgccgttcagacgggtcttttgcttgcgctgcgcgttaaattttcttgccggccgacagcccgcctgcaaaaattttctttcccaggtacaaaattcctcgcctgtccggcatcctccggctgtgaattcaggttctcatttcaggatgccgcaggcgtcgatcgcatcgattgcataacgcatctccgcctcgtcctgcacaagcgcgaggcgcacatgcccttcgccggacggcccgaacgcgctgcccggcgtgaccagcacgcccgcgcgctcaagcagctccacggcgaactgctgcgcgtttgtaaagcgcggcggcagcttcgcccagacgaacatcgtcgcgcgcggcttatcaatcggccagccgatcgcgtttaaaccgccgcacaggatatcgcggcggtcctggtaagcgcggcgcgtcgtctccacgcacgactggtcgcctgtcacagccgcgatcgccgccttctgcaccggcaaaaacataccgtaatccatgttcgatttaagcgcagccagcttggctaccacctcgcggttgccaacgcagaatccgatgcgcgcgccagctaggccgtaggtcttggagagcgaattgaattcgacgcccacgtcgcgcgcgccctcaaagcgcaggaagctgccgcaggtttcgccgtcgaacaccagctcgctgtacgcgttgtcatgcagtacaatgatgtcgtatttctttgcaaacgcgatcagatcgcggtaaaaggaatcgggcgcgatggccgtcgtcgggttgttcggatatgaaacaaccatcagtttggcggctctggccgcctcctccgggatcgccgcaaggtcgatgatatatccgttttcccggcgctgcggcatatagcacagctttgcaccggcgatcagcgggccgccgccgaacaccggataacacggatcgggcacaagcacaacgtccccttcgtctgcggcgaccagcgcgatatgagcaagcccttcctgcgagccgagcagagaaaccacctcggagcgcggatcgagcgtcacgccgtaacggcgcgcataccacgcggcgacagcgtccgaaagggcctcggtatcgctgatcgcgtagacgtaattatgttcgtcgcgcgccgcctcgcacagcgcgtcgatgatgtgcggcgcgggcgggatattcggcgtgccgacgcttagatcgaccacatgacgtccctgcgcaagctgttttttcttcatgtcgagcaggaccgaaaaaattccaacgccaaaccggtccatgcgctttgcgaattccacagacagcagccccttttcccggccggcttggccggccctcgtttttccttttttttgatcgtgtccgcagcgcggcatgatcgaatcggccatcagggcgacagcgagccgcgcccgcgtatcgccccggccataaagaatagaataaatgccacgcatttattctatcacattcccccgcccattcctagagcctgtttgaaaaatcgggcgcatcgcctttcggggtttgaaagctaaaaccggccgccggataaagacggcggccggtttgtgttgttttatgccccgcgcttcacagagcagtcaatgagcaacaggatataaagcgtaaatatcagcccataaagcaaaattgctgtctgaagctgtccatagaaagccgaataaagcgaataggataccgcttttaacaccggcggcagcgcgcacacggtcaggacaagcagcccgccaaccgccgcaagcggatggcaccgcgccttttttaaaaagaacgcccagagaaaacaggccagagcgatgaactgtgctgcccaaaaacagacgtacaacggcacgttcaggtccatcctgcgcatctgcgccccaaacgccgcctgggctgccagcgacagaggcgccagcagcggaaacacaaggagcgcaagatttatgggccaaccggtccggccgtttcttttcatccatcacgccttctttccatcatcgcacgcccatacgatcaatttcagcatacccccatccggactatctgtcaagagcgcctgcaaatctgccgcaaggccgccaattttcttgacgcccactctgcgcacatataaaatagaagtatcccatgattaaaagggtgaacccgctatgaatccgaaacgatctgccgctatcctcctgctggcggctgttctgtgcgccggctgcggcgcacagaacaagcagcttacgctcgaaaatatccggcggctttctcaaaagggcgatgctctgacctggagcgactttgaccggtatgaatgcagcgacgtcggttccgggatgatcgtgctgcgctatcccattgatgatgaatacactctgatagtcggcggaccaagcagggagcagccgcccatgtacatccgcctgacacgcgcgcaggaagcggtggagctgcgcggcggggatatcgacaccttcctcgcgcggcaatcagatcacgcgtcggactgacctttgatgatggcgagctgggcgcccttataatagtgggtcaaaatctcgtcgaacgtcgcgccctgcctggccatatagtccgcgccgtactgcgacaggccgacgccgtggccgtagccattgacggtaaaggtaaacgacgatccgtcgcatgcgatggaaaaatcagacgaacgcaggccgagcattccgcgcaggtccgcgcctgaaatcgtctgatcgccagcggaaagctctgtgacatagccactcggtgaccgctcctccactgtgagccaggacgacggatcatcgccgagagcgatgcccgggcagccctccgaaagcgcctggcgcacctgatcggcggtgaacgtttcggttgttgtgtaatctggcgcaagcgtgtcgccgaagctgtccaccgggacaagatacggcgcgccgccgagccagacgtttgacgcgtcctcggtcgttccgctgctcatggaatggtatgccgcgacgatcggctcgtcatcgtacagcatgatgtacggatatgcagcgtcggccgcgtcgcagatggttttccaccatgcgtcggcaagcgtaccgtaacgctcataaaacaggtcctttgtagtatatgttttccaatcggcaggatcagccgtgaaatcagcgcccttgagcgccgggtctggttcttctgcagcgcggcgcgactgcttgagattcaaagcgtatgtatgcgcagcgatcgcctgtgccttgagcgcctccggatggaaggtcggcggcatctcagccgccagcgcgccgcgcacataatcctgtgcgctcacctcaaataccttccccgttcgttcgtccaggatgcgaaatccgctgtcatcaacctgtgcaacaggcgtttgcagactctcctgctttgccgctgcctgcgatgattcagattccggcgtctgcacatccgtctcctgtacatccgccgcctgcggcggcgctgaagatgtcagggccgtgccggcctgctcctgtattcccccgttcagcgccatcaatgggattaaaaacatcgccgcggcgaatacgacgcccgcaaacagattgtaccgcattgcacttcctcctttgtttttgaaagaatacgtttccaatcctgcattttgcttgaatatactcttgactttacggcgactgggcgatacaattgaatatggaaaatatagctgattcaaaaatgctcgtccggcctctgccggcgacgcgccggaaaggagccttccgccatgctcggtaaaacagtcagcgcgcccgatgcgcagttaaaacaggacattcaattactatgcgggcagtacgcgcagtataacagctttgatccggagctgttttcaaaatttgcggtcaagcgcggcctgcgcaatgccgacggcaccggtgtgctggcggggatcacacagatctgcaacgtacacggctatctgttgagcgaaggcgaaaaggtccccatcgacggcgaattgacttaccgcggctacagtatccgcgacctgattgcaggcgcgcaggccggcggccgttattgctttgaggaaacagcctggcttttgctgctcggctttcttccggacggcatgcagctccgccgcttttttgatatcctctccgacgcgcgcgcgcttcctgacaacttcaccgaggacatgattatgaaggccgccagcccaaacatcatgaatatgctcgcgcggtcggtgcttgcgctgtatacatatgatcctgcgccggaggacacctcgatcgaaaatgtcatgctccagtctattcagcttatcgcgcggatgccgtcgattatggcggcggcttatcaggtgaaaaagcgcgtttacgatgggcgcagcatgtatctgcacaacccgaatccggaattttccaccgcgcagaatattctgcgcatgctgcgctccgacaaacagtttaccgaagatgaagcgcatctgctcgacctgtgcctgacgcttcacagcgagcatggcggcggcaacaactccacgttcgcagtgcgcgtgctcacctcgtcgcgcaccgacacgtattcagcgatctccgccggtatcggcgcgctcaagggtcctcgtcacggcggcgcaaactttaaggtgatcgagcagcttgaatatctcaaggccaacgttcgtaattgggatgacgacggtgaaatccgcgattatctgcggcgtgtcgtgcgcagggaagccggcgaccgttccgggttgatctatggcatggggcacgccgtctatacaaagagcgatccgcgtgagcgtctgctcaaggagaacgccctccgcctggcgcgtggcacagaattcgaggcggaattttgcctgctcgacgcaatcgaacggcttgcgccggacgttcttcacgaaaagcagggcggcgacaaaccgatctgcgccaacatcgatctgtattccgggcttgtctaccggatgcttggcatccccgacgagctgcacacgccgctgtttgcatgcgcgcgtacagccggctggtgcgcgcatcgcctggaggagctttcaaccggcggcaaaattgtgcggccagcgttcaagtcgattgttcatccgcgcgattacatcccacttgaatcacgcgccaccgccgcagtctgaacagcgcgcatcaaaacaggcgccgtcctgtttttcgcagcagaaataccgcttgaccgcagcgcggccaggcggtataattattagaagtatttctgccgaaggcccattcggcgggacgtttcacacagattttcccgcaacgatatatccccaattttggaggtcattatgacaatcaagctctcaaagcgcctgtttttggcggccgccattctgtgcgtcctgctgcgctgcgcgctcaagtttatatccatcgatcccgacaccggatattacgagggatatgacgcgctcgtcctcctgttcaacctgcttttgactgtatcaaccgctgcgctgatcgttttgcctatgctgaaaagaacttctgaaatccgttgtgtttgtttcggcagcgcggcgcgtttgttttcgatactttccggcgcggcgctgctcctgtttgcggctggacgtatttccgcctcgattgcggaaatctcctctgtctccgacgcatcgccgctcgccttcctgttttcaacgctcggcgtttttgttttcatgggaatcgtgccggcgctttccggcggcatcctgatcgcagttggcctgcgcgcgcgcggtcagtccggcgcgggcggaatgaacggctggctgctgcttgttttgcttgtttggcaagttgcgcagctgcttgtcacattcatggattttacagccgtccgccatgtttcggaccagatgctggccgtcatgtcgatggtgcttggagcgcctttctttctcgcgcatgggcgtgttctctccggaatcggacacgataagggcgtgcgccagctggcggcgttcggcctgccgttcgcgcttttgtcgctgacgctttcaatcccgtcgatcgccgcgtcactggccgggcgcgccttcccctttggccttccgctgaccggctcggttctttatctctgtctgggcctgtatgccgcatccctggggctttccatccagcgaaaggccgtgcatgccgcaggagaggcaaactgaaatacgaatagaagaaagccgccgggcattgcccggcggctttcttttatcagcggtacgcctgtgtgaacgcagcgcctgcatgccgttcgcggctcggccggctaaagttttttgccgagcttttttcaaaaagaccggagcaaaatccacgccagccctgcggcgtatgttatggattctgctggttggcatggctgcttctgaacaaggtgccttgcggcctgcggccgcgttttttatgagggctgcggcccggggagcaaggcgccgccctcgaaaaatcgggcgaaaacttttgattgcgcaatgcctatcccgctgttcgcggcgcagccgattaaagtttttcgccgaggccttttttcaaaaaggccggaaggtttttgccgggcttttttgaaaaaagcagggaaaatcaggcgggaaggccggcggcgcttttcatgatctgttcctgcgtaacgcggctgccggatggatactccttcatcatgcggccctcgtaaagaacgacgatccggtcgcaggcgccgatgatctccggcagctcggacgaaatcatgatgaccgcgatgccctgctttgtcaaacggtcaatcaggcgatgaatctccgccttcgcgccgacgtcgatgccgcgcgtcggctcgtcgaggatgacgacctttggactgcggttaagccattttgcaaggcagaccttctgttggttgccgccgctcaaattcatgatcaattgttctgtggacggcgtcttgacgttgagagaatcaatatactcctctgtgatcgacaaatccttcttcgcgtcgatccagccaaaccggctgatccacggcaaggcggccagcgtcgtattctcgcgcaccgtcatatgcgggataatcccttcgcggcggcgatcctcggaaaccatcgcgatcccggccttgattgcgtcaagcggacagcgaatctccagctttttgccgcccagataaatcgcaccgctgtcgggccggtcaaggccaaagatacagcgcatgatctctgtacgtccggcgcccatcaggccgctgaagccaagcacctcgccagcgtgcacggaaaagctgatcggctcaaacgcgcctttgcggctgagattctcaacacgcagcacctcctcgccgggcgcgcccttttcacgtgtgaaaatatcgttcagttcgcggccgaccatgtgccggatcaccttattttcgtcaaattccgataccggtccagcgatcacctggcggccatcgcgcaggatggtgatttcgtcggcaatctcaaagatttcagacatgcggtgcgagatatagacgactgcaatgttgttttccttcaattcccggatgatcttaaacaggttttccttatcggcctcggtgatcgcagacgtcggttcatccatgaccacaatccaggcgttcgaaccgaacgccttggcgatttccaccatctgctgctgcccgaccgtcaattggtcgattttctgccgcacaccgacctggagctggaaacggtcaagcaggctgcgcgtcttttgttccatgcgctttgtatccagaaggatgcgcgcgccgtttgacagttctttgcccaagttgacattctggcttacgttcagctctgggatgttggcaagctcctgatagatgacggaaatccctatccgttcgctgtccgccggcgaacggatctgagcgggcacgccgttgatcaggatttcaccctcgtcctttgtgtagacgccggagaggattttcatcagtgtcgatttgcccgctccattctctccgcacagcgcatgaatggtcccgcgcttgatggtaaggctcacgtcgtcgagcgcgcgcacgcctgggaacaccttgacgatgtgccgcagctccagaacatcctgcgcgtttgccgcgagaatctcgtcaagtccgcgtgcccttttgcccgtttgcggctccgcgccgccggaatgtccggccgcatggcgcaggacgcttttttgcgctttggcggaaacaacgcggttgcccagcaccgccaacagaataagcgagccttgtaccatataattgacaaatggtgaaaggtccagcatgctcaggccggtaaaaatcacagaagtcagcagcacgccgagcagcgtccctttcagattgccctggccgcccatcaggcttgtgccgccgatgacaacggcggtgataacgtcgaactccatccccacgcccgccatcggctgcgcggaacgcgcgcggccgacaatgacgattgtcgacagagctataaaaacgccggcgacaatataaacgcacagcgtatgtttttccacattgataccggacgcacgtgaggcgacgggattgtcgccgatcgcataggtcctgcgtccaaaggccgtcctggtcagcagcaggtacgccgcgatatacgcggccgctacaagcagcagggaaaccgggatttttccgaacagatccgtctggcttacaaaattataaaggctgttgtcgacaatgacacgcgaggaatgcgtgacggtcaatgtcagcccgcgcgccagcgacatcgtcgccagagtgacaataaacggcgcgattttaagataccccgccgcatacccgttgatcagcccaaagccggccgcggccgcgacggtcacggtgatgcccacgatgcccgccagcagcgtggagccgcccgccgcctgcatggccaaagcgcccgccgcgcctgaaaacgccaccacagagccaacggacagatcaatcccgcctgtcagcatgatcattgtcattgcgatcgcggccaacgcgttggaagctgcctgcctgaaaagattcatgactgtgttgaagctcaaaaagccctttgagacaaacgagaacaacacaaacagcaccgcgatcatcgcggcgatggtcatataccggaaggtttccccgttcattgccgcgccgcgttttttttgtttttttgccgtatccatccgctcacgctcctacattgatcgccggcagcaggccggtaaagctgcggcgggcgcgccgcgcccgccgcgaagggatataagagccctgccctttacgttcagcccgcgagaagatcggggtcatacagctcgtctctgtatccggcagcccgctcaagcgcctgcgccgggttgatgacgctgacgtcctccgtgccttcaatccccatttccgcaaacttcgccttgttttcatcggtcataacaaagtgcgtatcaagattaagtatcttttccgccgggcgcacgccgctggccagttggagcgccacctggatgttccaatagccggtctttttcgcgccggtcagaactgtgctcgtaaactggccggactcgaccgccttgagggcgtcgtcgttaccgtcatagctggtgacgatgatctcgccttccttaccggcagtcttaaccgcctgatatgccgcgagcgtgaccgcatcggaaatacagtgaatcgccttgagatccggattagccgcgatcagatcctgcgccgccttcattccggtcggagggtcccagttggtgggctgttccaccactgtgatattcggatatttttccatacccgcataatagcccttctggcgcagatcggagacgagattgcctttgttgccgtaaagcagggccgtcttgccctcctcgccgatcatcttggcggtcatctccgcaatgatgcgagtattttcctcgtcgttgtagacggtggtatagtttgtttcaacatcgacctggcctgccatggtaatggtggggatgccggcggccgacgccttttcgatcacaggctttaagccttcgctgtcaagcgggtcgaccaggatacagtcgacgccctgctcaataaagttctcgatcagcgaaatctggttgtcgaaattgccgtcggcgcttttccagatcacctcacagccgtaatcctcggccgccttgttgccgccttcaatcatatcgacaaagaactgattggtcatatcgatcagcacgacgccgcagacaatcttgtccgcgccgcccgccggctgtccggccggttccgacgccggcgcggtccctgaagccgccggcgctgccggcgccgcggaggacgctgccggcgtaccggagccgcagccggccagaaacccggcggccattgtaagcgccatcagcagcgcaaatgctcttttcataagatacgtctccttttcaatctgtttctccctgtaaactccactactgctttttacggctgacaaccgcgtcaaacgccacagcgagcaggatgacagcccctttaaagacctcctgcatttccgccgggattttcagatacgtcaaagcggtgctgatcagcacaataatcaccgcgccgatgcaggtgccaagcacattgccgcggccgccgctcatgcttgtgccgccgatgcaggtggcggcgatggcgtcggtcagcgtcgtcccggagatgctcggcgtggccatcgcgatgcgcgaaaccgtcagcatcgacgcgatgcccgtacagatcccggccacaacgtataccaaaattttataccgtttgacatggatgccgctgtaccacgcggcgtcctcgttgccgccgagggcgtatgtatagacgccgagctttgtccggcgcaggatcaccgacgccgccaggcagacggccagcagcaccacaaaggataccggcagcacgccgccgatctttccctgcccgaccgccaggatcggcgaatcggtgagcataaccatcgtaccaccgccgatcatcagagacatgccctgcgccagcgacatcattgcgagcgtcgcaataaagggcagaatatcaagcgctgcgatcagcaggccgttgacaaggccaagcagcgcgcccatgccaaggaacgtgaccaccatggcagcgacgctgccctgaaagggcgactgcgcataaaccacgccggccgccataccgatcattgccaggccgtacccggcgctgaaatcgatcccgccggtgatgattacaaacatggccccgatcgccacaacgcccaccgccgatacctgctgcatcaggtttacaagcgtttgcagggacaggaagtcgcggttgagcaggctgagcgccagcagcaaaaccgccaggatcacaaccggcatcacccgctgcaaatccggcttcaccctgccgccgggctttcccgcgcgcactgtttccatgacatgccaccccactttactgctgtgtccttatttttcttccccggccagccagcggacggcctggacccagaactttccgtaatattcccacggctggaaatactccgcccagtgcggcgagcagtcgcttgcaaacgcggcggaacggcccttgccgtacgaccaagtcacaagcagcggcgattcgatctcctcgtcgccgatcgtcgcgatgacgttggcgccctctttcgggatgatcttgttaaatccttcaaagaccggcgcttcctcccatgggatgtcctgcatgatcggatgcgccttgtcaagcaccttgaccttgacgcccgccgggacctcgacgcggtcgtcggcgcccttgaggcagttgaccggcagagcctcctcgaccggggtgtcataatatgcgcctgtgccgaagcgcccgctgaacgacgaccagccgccgatcatcatcagaccgccgccgtttttggcatagttgcggatggcgcgcatcctatccgtgcgcggcagcggcgtgccggcgacccagaacggatagagggacaggacctcggcctcgcaatcgctgatgattacgacgtcgtattcggcaagctcctcctccgtgcgcggaaattcgccgatcgcctggtcgttcgtcagatgcttgacctcgatcccgtccgcggtcagcgcgtcgatcagcggctgtccccagatgtggtgagatacgcccttgacctcaaggttgaaaggggacgcgacaaatacaggcccgattttggtgcaggcgtcgccggcgtaaagaactttcattttcatttcctcctgattctcttttattgaatatcgacgggcaggcccgtttcaattgacttaaaacacgcctcaatgatcttgacggcggtgatcgcgtgctcggtatttgtaatgtacggcgtgccgtcgagcgtcgcggtcacaaagtgatggatttcctccttgagatcgccctggatgcggccgttgtactccggccagtggagcgtgtcggggtaatagacgttcgattccgtgatcagcgagacgccctgatccatgatcgtgacatagcccgcgccctttacgccgacaacctcggcataagtattgatacccagcgcgctgttttccggcagcgcccagcaaagctcaatggttgcgaccgcgccgttttcaaatgtaatggttgagatgaccgtgtcctcgcagccgatgtcggcgtttaccttgctgacacgctggcaataggcgcgaagcgggcggcatttcatataggagcacatcatttcaaaatcatgcacgccgatgaagtggaaaatggagaccttcccgcccagacgccgcccgtttgagcgggggtttgtacggcggaagaacatatgaatgacgtcgccgatctccccctgatcgatcgcttcctgcaatttggcatatctgggatcaaaatgcagcacatgcgcgaccatcatgcgcacaccggcctgagcggccgcggacgtgatctcacgcgcttcgcgcccggtcggggcgatcggtttttcaatcaaaaggtgcagcccttttttggccgcgtacagcgcgttttccagatggaattgatcgggcgtgcagatgcagacggcatccagagcggcctcgtcgcacattctgcgaaaatcagcgtaccattggcagccgtatcgctctgccgcagcgcgcgccgcgccctcattgatatccgtcaccgcggcaagcacggcgtttggacattcgtggacaatgcgcgcgtgaagcccgccgatcagccccaatccgatgaccccgatccgaagtggattttgcatgttcaatcccctttctgtatttacatatgcatctgtaaattcgttctgtttccaaactaactttatctgcatcttatcatcgactctttgcattgtcaatataaaaatatcttttcgtgaatatattttacatataattcaaaattaacgcatctttattgtgcaaattgccaatattgccttttgcggcagacatgttatgataataacaaagaagcagtttgttttctttccttacgattggagtgaccagattgaaccatacggtcgatcagacacatatccgcagcatcaaccagcgggtcatcctcgacagcatctatcatacggagagcatctcacgggccgccctttcgcgccttgtccatatcagcaagtccgctatgacggagaatatcgcggccctgctcaacatcggcatcatcgaggaggtcggcgcgggcagagccatgccgaccggcggacgcaaaccaattctgctcaagtttaacaagaattataaatacatcgtggcgatcgatctcaactacgaggagcctatttttgtactggccaaccttggcggtgaacgcatcaaccacttcaccatcaatatcacgccggccacctccttcgcgacgcgcctggagcttgtcaaaaatgcgatcgcgaccctgaccgcctccggcaacctcgctaacacagacctggccgtcatcgcgatttcttctcccggcatctatctgccggaaagccgtgagttcagggcgaacacacagtttaccaactggaaaataccagagctgtctcaggcgcttgaagaaacattcggcgcgcctgtgcttattgtaaacgacgtaaacgccgctgcggtcggcgagcttaattacggaatcggcacaggcaagcgcaatctcgtttattttagctgcggcctgggcgtcggcgcgggcattatcatcgacggcgcgctctacgaaggcagcggaaaaagcgcgggcgaggtcgcaaactttttggtccacagcccggacggacccgtcccgcttgaaaaatacatcggcctggacgccctgctccaacgtgtccgcgacaaggcgcccgcgcaaacgctgcacctggtgacaaaggaaaccggcgccgtgtcctttcgcaaggttacggccgcctggcaggcaggcgatccgtttatccgcgcgtgtatcgatgaaattgccggcctgatcggtacagccatcagcaatatcatttccctgctcaattgtgatctggtgattttgggcggcgaataccatgtttttgccagccagatgctgcccatcatcaacagtattgtacaggaacacgcgttcagccccgtgccggtcgtcgcctcaggtctttcacgggattctggtattttcgggctgttcgctctctccaacgagattattttcagccggctgtgcggcagatcaaacggcgggaacaggatgtgaaagtatgttcaacctcggtgtggatctcggcggcaccaccatcaaggtggggcttgtcgcagaaaatgggaccattgctgcgcgcgcggcctgttccacatgcccggagcgcggcgcggccgaaattatccgtgaaatcgccggcatctgtcaaacgctgtgcgacagccaggccgtcccgctctccgatatcaacagcatcggctttggcacgcccggcttcattgaccgtgcgcgcgcggctgttatctattcggccaatctcgggtttcatgacgtgcgcatcggcgaggagctgtccgcatttttcccgcagatacccgtctatgtggaaaacgacgccaattgcgccgccatcgcggaatcggaatcgggcgccgccagggcatatgccagctcggtgacgattacgcttggcactggcgtcggggctggcgttattattgaaaaaaaggtgttcgtcggttacagcaacctcgcgccggagatcgggcacctcgttatcgaaaccgacggcgaaccctgcccatgcggccgcagcggctgcatggaacggtatatttccgcgacgggcctgatcgaacagacggcgcgcgccgtctgctcacacccggattcccgcctggccctgctggcgcacgaggacggtgcgatcacagccaaaacggcgtttgcggccgcacgccaatccgacgcggctgcgcaggaggtaatccaacggtacctgcactatctggccatcagcctgtccaacattgtctactgctacggcccgcagattattgtcctgggcggcggcgtctgcaacgaaggcagcgccctcctggagcctttgagccgggagcttgaccgcgtcctgatgcccgactcgcgcggcaaggttgccctcgcccttgcgcactataaaaatgacgcgggcatcatcggttccgccatgctttacagattcagatgaacggcgcagaggacagatcatttcagaacaaaaaacccgccgcagcccatcagggccgcggcgggttttttgttctgaatctatccattacgcagcgggtacagcatcgcccgcaagctgtgtcggaatcggctggccgtcgcgctcaagcagcttattgcgcagctcgaccgggatatcacgaatggcgagaatctgataatggtcgccgaccctctccagatcataatacatccatttatcggactgcggccgttctgtcttaccggtggcgctctgccgccaaacatcgttgggcggcacatagccgaccagcagagtatattgatttcccttcttgacaatctcctcaacgttcggcgtatacagccccacctggcctgtcacctggacataatacgtcttggtatcctcatcatagacatagttgtcgacatagttaaccgtaaacgactggtgctccagcttgacgtctccataaagccgcgcagccgcgacatccacatcggaagccggcaccggaatgcggccgagcgagtcctcattggcctgatagctctcacgcttgtcgccgagcagcgcgctccacagcgacgattgcagcagaaacagcgggtccgcgtcagcggcgctgccaaacggaaccgggtcaagcatcagaacgggcgtaatgacctgctcaaaccgtgctttttcagcgctgttgtcaagcagccgctgtgtaaaccgcacgcagaacacgcacaccgtaacaagaccaaccgccgcgagcagcaggaatacgatccccaccggggcgacgtatttatgccgccggaagcgtacctcctcctgcatttcacgcagggctgccttttgcagcttttttcttttatccatgccagattcctttcaaatgcattcagcggatttgaccgttgccggtcacgatatatttgcaggagcacagctccgccaaccccatcgggccgcgcgcatggagcttctgcgttgaaatgccgatttctgcgccgaaaccaaattcgcctccatcggtgaaacgcgttgacgcgttgatatagacagccgccgcgtcaacgcgggcggtaaaggcttgggcgttggtataatcgtttgttaatatcgcctcggaatggcctgtcgtatacttctgaatatgctcgattgcttcatccagactgtccacaacgcgcagcgcgaggatatagtcgtcaaattccgtcgcataatcaagttcagtcgccggcacgacgccgccgatcagggcggccgtgcgcacgcagccgcgcagctcgacggcatggctgtcgagcgcggcctttaagcgcggcaggaacgccggcgcgatatctctgtgaacaagcaccgtctcaaccgcgttgcagacagacggccgcgaggtctttgcattgtcgcagatgcgcacagccatctcaaggtcggccgaagcgtccacatagatatggcagttgcccgcccccgtctcgatgacaggcacgcttgcgttttcaacgaccgagcggatcagtcccttgccgccgcgcgggatcagcgcgtcgagatagccgtcgagcgtcatcaggtcggcggcggaggcacgcgtcgtatcctccacaagctgcacacagtcgcgcggcaggcccgccgtctcgattgcatcccgcatcaaattggcaaacgccatattggagcagatggcctccttgccgccgcgcaggatacatgcgttggccgatttaaggcagagcgccgccgcgtcgaccgtgacgttcgggcgcgcctcatagatcatgccgactacgccgagcggaacgctcaccttttcgattttaagaccgttcgggcggctcccgccgccgagcacacggccgaccgggtcttcgagcttggccacgaagcgcacagctcccgcgatggatgcaatgcgttcctcggtaagccgcagacggtcttgcagcgattctgtcatcccattgctgcgcgccgccgcaagatccttttcattctccgtgagaatgtctgtacagtgcgcgtcaagcgtatccgcgaccgcatacagcgcatcgttgcgctgcgctgttgttgtacagccaagcacgcgcgaagcggcgcgcgcccgtttacctgtttccagcaggctgttcataagccagacccccttttaaattcattcacaacggcccccaaaatgcagaccgcctatttgcgggatgcagggaaatatgttcccacatcacggccttcaaacagatcatacagttttttcggagaagcgccgttcatgataaccataccgatcccattctgcaccgcaatctgtgcggcatggatttttgtcaccatgccgcccgtaccgcgcgcgctgcccgcgccggccgcgcacgcctcgatctccggcgtgatccgcgcgacctcgtgcagcagattcgcatttggatttatacgtggattgtcgtcataaagcccgtcgatatcgcttaaaatcaccagcagatccgcgccggcaagcgccgcgaccatcgccgacagcgtatcgttgtcgccgaattcaatctcctctgtggaaacagagtcattttcattgacgatcggcaaagcgcccatatcgagcaggcggcaaagcgtattctgcgcgttctgtttgcgcgcggcgtcgtccacaacgtcgcgtgtcaaaagaatctgcgcggtcacatggtgatattcggcgaacagcttatcgtatatgtacatcaattcacactgtcccacagccgcgacggcctgcttgccgggcatgtcgcccggttttttatgcaggcccagcttgcccacgccgactgcctgcgcgcccgagctgaccaatacgacctgtctgccgctgtttttgatgtcggcaagcaccttgacaagctgttcaacacgccggatattcagcaggccgctttcatgcgtcagcgtcgacgatccgaccttgacgacaatacgcccggtatttgtaaaatccctcattctgtttgctcccccgaacggcctaagcggccggttcttatttttccgcgtccctgccggtatccgcttcatccggcggcaaaagcttctcgacacggagcgaaaggatacgctgctcctcgacggcgacaaccgtcacgcgcagatcgcggaaggcatattgttcgcctgccgacggaatatgcccgagcatctcaagcgcccagccgccggcagtgttataatcgctgtcaaaatcgcggtcgtcctcctcaagctcctcaagcatggaaaatacattcatatccccgctgaccagatatgtgtccggacctgtctgtacaaaatcatggcggacctcgtcgctctcgtcccagatgtcgccgacaagctgctcaagcacatcctccattgtaacgatgcccatcgtgccgccatagtcatcggtcacaacggccagatgcagcttcttcgccttaaattcagcgagcagggcggagattttcatcgtcttatgcacaaaaatgcagtcggaaatcaagtggtccagtcgtgtctggcgtccggtgacgaccgccttgagcagatcgcgcacctgtagaacgccgatgatgctgtcaacagttccgcggtaaaccgggatacgcgaataatgcgcgtcaagcaccaccttgagcgcctcgtcgatggaatcctcgacatcgagcgtcacaaggtcgacgcgcggcgtgaggatctcctgggcggttatctcgtcaaagtcaagcgccgactgtacaaggtcgctctcctgttcctcaagcacgccctcctgctcgatcgattcaacaatgtatttcagctcctcctcggtgacggacggctgtgccgccggccccttgacaagccgcagagcaagctccttgatctttacaaaaaagaatacgattggactgagcagctttataagaaacgacagcagcccgccggcggccatcgcaatgttttcgctgttttcctttgcaagcgtcttaggcaggatctccccgaagatcagcacaagcaccgtcatgacgaccgtcgcgaccgccgcgccgctggccccgaacatcgctgtcgcaacgaccgtcgcgatggaggcgctggccatattgaccacattgttgccgaccagaatggttgacagcagccggtcgaaatcatccgctacataaagcgcgcggcgcgccttgcggttgcccgcgtcggcataattcttcatgcggattttgttgagtgaggaatacgccgtctcgctggccgaaaagaatgccgaaaatgcgagcaatgccagcaaaaccaagtataatatgccgcttgtactgtccaagaaaaaaccaacccccgaaattacaaatagtattttttagacacaataatacaaataaaccgtttcttttcatgcgcataaccacgatactatttatcataccaaataatgtggcctgctacaatcgattttatcatatgtttaccgaaaattcaattcccgctgtatacgccatcgcgttcagcgcgctttctgcaaacgcccggtaacgaaggcttcgttaccgggcgttttgattttattgggtatagcggcaagctgtaaaggcttactgctttgcagcgtttttcttcgcttccatcgcaataagcgcatcgcggcgggagaggttgatgcgtccctgctgatcgatatccgtcaccttgacgatcacctcgtcgcctacggcgacgacgtcctcgaccttttcaacgcggcccatatcgagcttggagatatgcaccatcccctccttgccgggggcaagctcaacgaacgcgccgaagttcatcagccgtgtgacgcggcccttatagatcgcgccgatctccggatcgttgacgatcgtctcaatgatcgaaagcgcgcggcgcacgccgtcggaatcggtaccggcgacaaacacatcgccgtcgtcgttgatatcgatcttgacgttgcagtctgcgcagatcttctggatgaccttgccgcccgaaccgatgacctcgcggatcttatccggatggatcttgatcgacttcatcttgggcgcgtatttggaaagttcctcgcgcggcgcggggataaccggcagcatgatgtcgttgaggatatacatgcgcgccttatacgtcttttcaaacgcctcgcggatgatatcatacgtcaggcccacgatcttcaaatccatctggatggctgtgatgcctttttcagtaccgccgaccttgaagtccatgtcgccgaaaaagtcctcaagcccctggatatcgaccatggtcatccagcggtcgccctcggtaatcaggccgcaggaaatgccggcgaccgggcgcttgatcggcacgcccgcgtccatcagcgccagggtggagccgcagatcgaaccctgtgacgtcgagccgtttgaggaaagcacctcggaaacaaggcggattgtatacgggaattcttcaaccggcggaatcaccggctcaagcgcgcgctccgcgagcgcgccatggccgatctcgcggcggcccgggccgcggctcgggcgcgtctcgccgacagaataggacgggaagttatagtgatgaatataacgcttctgctcctgatcgtcgatgccgtcgagcttctgcgcttcgctgatcgtaccgagcgtggcaacggtcaacacctgtgtctgaccgcgcgtaaacataccggaaccgtgcacgcgcggcaacaggccgacctccgcggccagcgggcggatctcgtccattttgcgtccgtcgacacgcttctgttcatcgagcagccagcggcggacaatgaacttttgaagcttgtagatcgcttcatcaattaccgctgcgttcgtcttttcctcgtcgtcaaacttctcatggatgcgctcgacaaccggcgccaggcgctcatcgcgcacgttcttgttatcggtatcgagcgcggccttaacatcgtcgattgcaaaatccctgatcgcgtcgaacagctcgtgcgggacctccatcgactggaacgagaacttgggcttgccgatttcggcctggacgttcttaatgaacgcgaccatgcgcttgatctcctcgtggcccttgatgatcgcgtcgagcatcacatcgttggcaacctcgttcgcgcccgcctcgatcatgcagattacatcctcgttagcggccacagtcaggttcagatcgctctttgcgcgctgggcagcgtccgggctgacgatgatctcgccgtcgacaaggcccacattgatgccggcaatcggcccgttccacgggatgtcggaaatcgacagcgcgaacgaagtgccgaccatgccggcgatctccggcaggcagtcgggatcgaccgacatgacggtcatgacgaccgaacagtcgttgcgcatatccttcgggaacagcgggcggatcggccggtcgacgaggcgcgaggacaggatcgccttgtcggacggacgcgactcgcgcttgatgaacgagccggggatcttgccgacagcgtaaagcttttcctcaaaatcgacggaaagcgggaagaagtcgatgccttcgcgcggcttggccgaggcggtcacattgacgagtacaaccgtttcgccccagcgcaccagcaccgaagcgttcgacaggcagcacatcttgcccgtctcaaacgtcatctttttcccgccgtattcgatttcataaaccttgtagttttcaaacattgcagtacctccgtttacaaattttcatttacggaagccgcgtgtcttttagcaagtatctcggcgcccggcgcccgggcgtccagataactgctaaaaagcattcccgcggtttccgtttttacccccgcgcacgcgcggggtgatgcgagggaaggcaggcggaccgctgctccgcctgccttccgtgtggtatcgcttacttacgcaggccgagcttggcgatcagatcgcggtagcggttgatgtccttcttggccaggtagttgagcatgttccttcttttaccaaccatgcgcagcaggccgcggcggctgtgatggtccttcttatgtgttttgagatgctcggtcaggtcggcgatgcgcttggtcaggatcgcgatctggacctccggcgaaccggtgtcgccctcatgctgggcgttgttctggataatttcctgcttttcttccttacggatcatgtcaatcacctttctttattcagtcctcaatctcagagacaggcgggtgaattcccaacggcagtcggccagggctttgggcctgtgacacaggcgttttggtcctgcctccgtgaaaaaggccatatcgatttttcattataccatagtgtttccagaaagtaaagggcgcatgcgcctttatttgcctgttttttcaatatatgccccggcaatcggcacggacgcgcgcgcatctgcctggatgcgcgcgcgcagcgcgtcgaccgacgcaaacttctgctcgtcgcgcagaaactccagcaggcgcacctcgatctgccggccgtataaatcgcccgaaaagccgatgatatacgtctcggaattcacggcgtccgtctgctcgacggtcgggcgcagcccgatgttcgcaacggccggcagcagcgcgccgtccacgaccgcagcggccgcgtaaacgccgtggcgcaggcgcacaaacgatttagggaaacgctggttgatcgtcggcgaatcgattgttcgtccaagccgttttccatgtaccacagtcaggcgatagccgaaggcccgcccgagcagccgccccgcctctttaacgtcgccggcggcgagcagctcccggatgcgcgtgctgcttacgcgcacgccgccgcagagcacctccggcacgatctcaagcgcgacgccgcgcgacgcgcacagcttttcgagcagcgccgcgccgccggcggccgcgcgtccaaaccggaaatccgccccgcagcagacaacgcgcgcgcccatgcggcgcacaagcacctcgtcaaaaaattcctccggctccaggttgtgaaattcggagaagtcgggcgcgagcacacgctgcacgccccatgcgtccaggatcgcatatttatccgcttccgtgacgatctcccccgcgccggtcttgcgttcggggctgccgccagcgcgtgtaaaggtaaacacccccgcgcaaagcccctcctctttggcacgctgcacggcacggccgaccaccgcggcgtggccgatgtgcagcccgtcaaaatagccgcacgcaaccgccgccggcgcgccggcggcggcctgtgcaatcgtgtgaaatacctccaaagggcctacacctccagcgtaaacagcttctgcatacagagcaggccgtctcgttcccgcgcaacgcccagaaagcggcggtcatgcgcatatacggcgtatgtatcaccggtccgcttgcaggcgacgcgcccgatatcgagccgcacaccgtttaaaaacatctttgtctgcttctcgttgagcgccgcactgggcagcgcgcaaaacgccgtctccaccggacgcagcagcgtgccgaacacgccgtcctgagcggcctgctgcgcctgttcaatcgtcacgcagtccgccagcgtaaagctcgcggccatcgtgcgccgcagcgcggtcatcaccgcgccgcagccgagcgccgcgccgatatcggcgatcagcgtgcggatgtacgtccccttggaacagtgcacatcgattgtaaaggtattcgcctgtacgtcgcacgccgtaaaatcgatcgaatacaccgtcacgggacgcgcggcacgctccacctcgacgccccgacgcgccagctcgtaaaggcgctgtccgttcacacgcaccgcggaatacatcggcggcgtctgcataatatccccgaccaggccggccgcggccgcgcgcacccgcgcctcgtcggcgtccggcgtctgctcactgagcaccgtgccggtgatatcctgcgtgtccgtcgttacgcccagcttaaacgatgccaggtaccgcttgtcctgccgcggcaggatatcgcacgcctttgtggcgcggccgaaaaaaagcgggagcacgcccgtcgccatcggatcgagcgtccccgcgtggcccacgcgccgctcccgcgcaatcccgcgcagctttgcgacgacgtcaaatgatgtaaagccttccggcttgtcaatacataaaattccgccttgctctgtcaaacgaccaaatcctttcccccttgggaaccttccgccttcaggctgtcctgcgtgcctaaaacgtccctgagcacgccgagcacgcgcgccttggccgcctcaagcgtcccctccagcgtacagcccgcggcgcgcgcgtggccgccgccgcccagacgcgcgcaggcggccgatgcatcgacatattggctgctgcgcatggaaacgcgccagcgttccgggcccttctgctggaacgtcaccgccgcgtcgacgccctcgatctggcgcgggatcgcggcgatgccttccatatcctcctcgggaacgccggttttttcgatggcgtcgagcgtcatggcaataaacgcgatcctcttgttttcgtagtattcaagcgtgtccatcaccatgcgctcaagctccatacgcgccggcgattttgtctcgaacatcagcttgttgatgcggtagctgtcgatgccgtgctccatcatccgcgcggccagcaggtgcgaggcgggcgtcgtgtttgaataacgaaagcaccccgtatcggtcgcaagccccgtgtagatgcagacggcgatgcggtaatcgacctgcgcgccaagctccctcagcacacggtcgatgatctcgaccgtggcggccgccttcgcgtcgagcagcagccgcgcggcatagcccgtgttcgacgggtggtggtcgatgcacagatcaatcttcccggctaggcggccggcccacgcgccgagcagctgcaggtcggccacatcgaccgcgacaatgcacgacggcgtaaagtcgggctgcctttcagggacaaagcccggatagaggaagcaatagcgcggagggaaaccgtccgggcaggcgatgcgcgccgttttgcccatcgccaaaagggcgtagagcagcgcgaaaccgctgccgagcgtatccccgtccggtttttgatggcaaaggatcaaaatccggtccgactgcgcgagcagcgccgccgcctgccgttcgttgaccgcctgcgccatgccgttccctccttgtcaatgctcctgatcctgtgtgtgcagaccgtccagaatgcgcgcgatatccgcgctgtgggcgatcgaatcgtccgcgataaacgaaaattccggcagcttgcgcagcttcaagcgcgcgtttagttcacgcttgataaatccctgcgcgctgcgcagccccgcggcggcgcttttggccgccgcgatcccgtccatcgaactgatatagaccttgcagtgggacagatcgcgcgccaaatccagcttgacgatcgagatcagtcccgaaacgcgcgggtccttcaggccgcgcatgatgtcgcaaagctccctgtggatgtcctcctccgtgcgggaggccctgaatgtggccatacatgttctccttttgatcgcttcttacgccgggcgcccgcccggcgcgggcagccccgtccggttattattcgcgatattcctcaatctcatacgcttcgaagatatcgccttccttgatatcattgaattttgtaaggcccatgccgcattcataccccttggcgacctctttcacgtcgtccttgaaccgcttgagcgacgcaagcttgtcgtcggcgatgatgatgccgtcgcgcacgacgcggatctcggccgaacgcgtgatcttgccctcaagcacataacagccggcgaccgcgccgacgcccgtgatcttgtagacctggcgcacctccgcgcgtccaaggtcgacctcgcgcgtcttgggcgcgagcatccccttcatggctgtctcaacatcgttgatcgcgtcgtaaataatgcggtagaggcgcagctccacgccgtcgcgctccgcgttctccttggcgacggggtcggggcgcacattgaagccgacaataatcgcattggaggcgtcggcaagcatgacgtcgctctccgagatcgcgccgaccgcgccgtggatgaccttgacgcgcacctcgtcgttcgaaagcttctcaagcgactggcgcaccgcctcgaccgaaccctgcacatcggccttgacgatgaccggcagttccttgacgtcgccctgcgagatatggctgaacaggttgtcaagcgtcaccttctcataggaactgaactgttcctgcttctgctcgtgcttgcgctggtcgacaagttccttggccagccgctcgtcggcgacggcgttgagcacgtcgcccgcggccggcacatcgcccaggcccgtgatctcgaccggcatggacgggccggcgtgctcgacgcgctcgcccttgtcgttgagcatgacgcgcacacggccgaacgtcgtccccgcgatgaccgcgtcgcccacattgagcgtaccggtctgcacaaggatcgtcgcaaccgggccgcggccgcggtcgagcttcgcctcgacaaccgttccgcgcgccgcgcggtcggggttggccttcagctcgttcgtatcggccacaagctggatcatctccagcagatcctcgatgccctcccgcgtcttggcggaaaccgggatgcacggaacgtcgccgccccacgcctcgggcacgagttcatattccgtcagttcctgcatgaccttgtcgggattggcgtgcggcttatccatcttgttgattgccacgatgatcgaaacgcccgcagccttggcgtggttgatcgcctcgatggtctgcggcataatgccgtcgtcggccgcgacgacgagcaccgcgatatccgtgacctgcgcgccgcgcgcgcgcatggccgtaaaggcggcgtggccgggcgtgtcgaggaatgtgaccgggcggccgttgacctcgacctgatacgcgccgatgtgctgcgtgatgccgccggcctcgccctcggtgacgttcgtctggcggatggcgtcgagcagggatgtttttccgtggtcgacatggcccataacgaccacaatcggcgggcgttcgacgaggttttcgtcgccgtcctcctcgtccaccttaaacaggcgatcctcgatcgtgacaacgacctctttttcaaccttggcgccgatctccatggaaaccatcgcggccgtgtcgtaatcgatcacgtcgttgacagccgccatgacgccaagccccatcagacgcttgataacctcggaggccgtcagatgcaggcgcgcggccagctcgccgacggtgatctcgtccgggatggtaatctccagcttctggcggcgctggcgctccagctcgagccggcgcatcttcgcgtcctccttctccttgcgggacatggccggcttgcccgaacggcgctgtgcgctgcgctgcgtcagcttctgcttctgcgcgcccgtatcgcggttgcccatctttgtctgggcaagcgtgtcgtatttctcgttgtagcggtcaagctccacctgcgtggagccggcgcgcatatcgaccatcgccgacccgcgctggcgcggctttgtccccggctgctgcgccgacgaagccggctggccgccctgctgcgggcgctgctgctgcgggcgtccctggccctgctgcggacgctgctggccgccttgctgcgcccggccctgggcgcggccgttctgctggccctgctgcgggcgtccctggccctgctgcggacgctgctggctgctctgctgcgcccggccctgggtgcggccgttctgctggccctgctgtgaacggctctggccctgctgcgggcgctgctggctctgctgcgcccggccctggccgccctgctgcgcggccggctgctgcgccggcgcggccttgcgcgcggcttcctccgccgttttgcgggcggcctcctgcgcggccgcgcgcgcctgctcggccgccttgcgcgcggcttcttttgccgcctgcttctttgcctcaccggccgcaaaatattcgtcgaagctctccacctggttctgattcgtgtagtggttgagcacaacgctcaattcctgctcgttgagggcggtcatgcttttgcgctcgcccggaatacgctccgcaagcaggtcgacgacctccttgctcgctacgccgaggtcctttgcgacctcgtgcaacctgtacttttcgatcattcgttgaattcctcctctgatcattcgcggctgcctgccgccgtgacgttcgcaaaccacaggcgccgccgcggagttggaacgctggattctctatataaagaccatatcggttgattacgccgtaccgtcgggcaaaagccccaaaatcatatcagcgaagccgcggtcgcagaccgcgaacacgccgtaatgcttacccgcaaccggggctaactcctgcatcgtgtatggaagcgtgcgcaccggcacgtgcgccggaccgcatatgccgcgcgcatggcgcgcggagcgttcggcgatgtcgcttgtgagaagcaccagcttcgcctcgccggacaggacgttgtcgcgcaccacatcggcgcccatacgaagccgccgcgccttgcggcagagcgaaattgccgaaaacagccggtcattcatgcggcgtctcccccaattcctgctccaggcgcgcatacacctcgtcgggaatcgcacagtcgagcgcgcgctccagccgccgggccttcctcgcttttttcagacaggcggcgtcaggacataaataagcgccgcgtcccgatttcttgccgcccggatcgagcaaaatcgtcccttcaggcgtgcgcaccacgcgcacaagctctctcttgggcctgtgggcggcgcatccggagcacatgcgcaccggctgttttttctgcatcgcgattcctcccgtaagcgcgggatacgcccgcgcgcgtcatggcattttattcgccgtaaaagccgctttccggcttgatatcgattttccatcccgtcagcttggccgccaggcgcgcgttctgccccttgttgccgatggccagcgaaagctggtggtccggcaccgaaacgcggcagcttttggccccgtccgggtcgacctcgaccgagacgacgtccgccggcgacaacgccgcggcgatgaattcggccgggtcggccgaatagcgcacaacgtcgatcttttcgccgccaagctcctcaacgatagcggagacgcgctgccccttcggaccgatgcacgcgccgacggggtcgacgttctcgtcgttgctccaaacggcgattttcgtgcgcgagccggcctcgcgcgagattgatttgacctcgatcgtgccgtcgaaaatctccgggacctccatctcaaacaggcgcttgaccagccccggatgcgtgcgggaaatcatgatgcgcgggcctttttcaccgttgaccacatcgacgacatagaccttgatgcgcgcgccgtcggcatattcctcccccggcacctgctcgcccttgggcagcacggcctcgcttttcccaagctccagcgtgacgttgcccctgacctgatcggtgcgcagcacggtggctgtcacaatatcgtgctggcgtgaggaaaactcagcgaaaagctgcccgcgctcggcctcgcggataccctggcggatgacgtgcttggctgtctgcgcggcgatgcgcccgaattgcttggtgtcaagcgggatttcaacaatgtcgccgagcgtggcgccgctgtcgtatttgacagcctcctccggcagaatctcctgcgcggggtcgagcaggtcgtctacaaccgttttgcgcatcgcgacataaaagcgccccgtatccgggttgatatcgacgacgctgtcctccgaagcgcccatgtcgcggcggatggcgttgccgatcgccgtggcgatcttttcggcaagcaggctgcgcggtatgcccttttccttttccatcagcgcaagcgcttcgaaaaactcggtattgctcgtattcatttttccggattcccccatcaatatataatgcacgccgtcgcagcgtcaaaattcttcataaaggcggacaaaggccgtctcgccgggcgagaaggtcatctccaattcgtcgtcgagcagcacggcgaccacgccgttttcatacgacgaaagcgcgccgacaaaatcgcgctcgccctcgaccggccggatcaggcgcacatgcacctgagcgccgatatatttttgaaaatgccagtcctttgtgagctttcgctccactccgggagagccgacctcaagcgtatagctttggtcgattggatcggcctcgtcgagcaggtcgctcacctcgcggctgaacgcctcgcattcgtcgatcgtgacgccgccctcacggtcgatataatagcgcaggtaccatcccgcgccctccttttcaaacgccacgtcccacagatacagccccatgcgctgtgcgaccggcgcggccagcgcctcgcagacggcggcggtattcgggcgttttccctgggcctttgccaccaaatccctccatacgcaaaggaaagagtgaggctgacctcactctttcacaatcgtttctattcttaccataacgtcagtgtagcatacccgcgcgcaaaatgcaagcatctttcgccggtttgacagacccctgcgcagttttttcatatcagccgggccgtttgagcgtccccgaggcgccgcggcggccaaaacgcacgctacctcgccgccttctcgtggtcctccatacggatctgcttgcgcttgatcttgccgctcatcgtcttgggcagctcgtccacgaattcaacgatgcgcgggtatttatacggcgccgtctccttcttgacatggttctgcagctcctttttgagcgcgtcggagggcgcggcgccgcgcgcgagcacgaccgtcgccttgaccacctggccgcggacagggtcgggcgcggccgtgacggcgcactcgagcaccgccgggtgcgtcatcagcgccgattcgacctcaaacggaccgatgcggtagccggagcatttgatgacgtcgtcgttgcgcccgacaaaccagatatacccgtccccatcgcgccaggccgtgtcgccggtcgaatacatgttgtcataaaaagcggccgcgttcgcctccgggtcgtcgcggtactcgatgagcaggccggcaggccggcccttgtcaagatttttgaccacgattgtgccgacgatgccgtcctcgcaggaattgccgtcctcgtcgacaatgtccaaatcgtacagcggcgaaaacttcccggtcgaaccgggcttgatcggaaaccacgggaaattggcgatgatgaccgtcgtctccgactgaccgaagccctccgtcaattcaaggccggtcgcctctttaaagcggttaaagacctcggggttgagcggctcgcccgcgatcgtgcactttttcagcgacgacaggtcgtatttcgacaggtcctccttgatcaggaaacggtacacggtcggtggcgcgcagaacgtcgccgggcgcaggcgttcaatcgtccggagcatatgcaccgggtcaaatttcccttcggtatcatacgccacgatgaccgcgccgcagatccactggccgtaaatcttgccccatccgaatttggcccacccggagtcggccgaaacgaaatgcagcccgccgtctcgcacctcatgccagtagttggccgtcgtgatgtggccgagcggataggcgtaatcatggacgatcagcttgggcatcccggtcgtgccggaggtgaaatatccaagcatcaggtcgtggacatccgtcgccgcttcgcctgcggggcgcgggaaatccatcgggcagtccgcgacggcgcgacggaaatcgatgcagtccgcggggattgtttcaccgacgaccgcaacgtgccgaagcgtcgtgcaggccgcgcgcacctgccggatgttgccgagcagctctccgtcgtcgacgcagcagatcatcttgatgcccgccttgttgcagcggtattcgatatcgtgcggcatgagctggtaggtcgccgggatcacgatcgcgccgatgcggtgcagcgccagcatgcacacccacgcctcgacgcgctgcttgagcaccagcagaacgaaatcacccttttgcacgccgtgcgccgtgaaaaaattggccgcctgcatcgaaagcgccgacagctccgcgaaggtaagccgccgctcgcccgcgccgccgtccacccagacgagcgcgggcttttttgcgtcccggcgcgcccactcgtcgatcacatcgtatgaaaaattgaagtcctccgggatattcagccggtaattcgccttaaaatcctcgtacgaatcgaactgcgtacgaggcagaaatttttcgatcatatacacccttctttattccgcctttggagcaggttcttattcgttgatgatggtcagaaaacggaccgggccgtccacggcgcgctgcccatgcggagttgacggattgaaaaaggcgctgtcgccggctttcagcagaaacgaacggctgccgatcacaagctgcaccgtgccgctgatcacataattaaactcctgacccgcatgcgtcacaagctcgggcggattttccatcggctcgaggtcgacgatcatcggatcaaagtcgcggtctatgtaattgaaggcgagtgaattgaaccggtagcccttataccgctcgaccgaaacgccgcgcccctgacgcacaattgtgtaatcgttcatacgcggcgcctcgccggtcaaaagaaccgtcgggtctacgttgagcgccgccgctacgccatatataacgccgatggggatatcgtcctcggcgttttcataccgttcatactcctcgggcgacagattcagctgctttgccagatcgatagccgctacatcgagaatctcccgcagttcgcggatgcgccctgcgatctgcttgatctgttcgttcatcacgatcctccttatagtccgcggtggcggtttttatttattgtacacgctttggcagtttcatgcaatacaaatatgcgcccgatacagacaactttctgcacatttttaagtaatacttatcatttttcaggtcgaattttgtaggacctgtcaaaaccgtcgtgtcctgtgtattctttttctgcactttttaccccattgaacaatctgtgaatttcctgtaaactgaatgtatacgtttcccctttttccgggagaagaacgcaatttggaggatcgacggaaatggagcttttgaaacagcgcatccgcgcggacggccttgttaaagccggcaatgtgctcaaggttgacagctttctcaaccatcagatggatatttctctcttttgtgagatcgggcaggagtttaagcgtctgttcggcgactgcggcgtgacgaaaatcctgaccatcgaggcctccggcatcgggattgcggctgtaacggcgcagttttttaacgtcccggttgtgtttgccaaaaagtcgcagtcgaaaaacatcgacggcgaggtgttcacctcgcgcgtggaatccttcacgcacgggcgcgtttacgacatcatcgtttcgaagaaattcctgctgccggacgaccgcgttctgctgatcgacgattttctcgcaaagggcagcgcgctcgaagggctgtgcaagcttgtcgaggactctggcgcaacgcttgtcggcgcgggcattgtaattgaaaagggctttcaggagggcggcgcgctcatccgcggacgcggcgtgcgtgtcgaatcgctcgccatcgtggagagcatggacgacaaaaccggcgagatccttttccgcggctgacgcggtcgattttctttcatgatccgactccgtgtgttttccacgcggccgcgcccgctgcacggcgggcgcggctgtgttttggaataagaacccgcataacaagcggggaatgttaaaattggaggagaaaaaatgaaactgagcaaaaagatccttgccctgctgcttgccggggcaatggcggcctctgccgccgcgtgcgcaggctccgagccggccgcttccactgccggcggcgcggccgcttccgcgcccgctgcttccgctccggctgacggcggcgaggccgccgcttccgaagccgcaccggccgacgattgggctgcaaaggtcggtacaaagaccttcccggcgattgcaaaggaagacttgaaaattggatttctctatgtcggtccggtcggcgacgagggttactcctacgcgcatgaccagggccgcgccaagatggccgaaacgctcggtctggccgaagatcagacgctgatcgttgaaaatgtcccggaggaatccgaatgcgccgaccaggtgcgcaacctgatcgaccagggctgcaacgttatctttgcgacaagcttcggtcatcaggactgggtgatggaggttgccaaggagtatccggacgtgatctttgaacactgctcgggattccgctacggcgaaaacatgaccgcctattttggtcgtatgtatcaaatccgctatctgaccggcatcgccgccggcctcaagacggaatcgaacaaaatcggctatgtcgccgccatgccgaccgccgaggttgtgcgcggtgcgaacgcgttcgcactgggcgtcaaatccgtcaatccggacgcgaccgtcgaagtcaagttcaccaattcctggtacgatcccgccggtgagaaaaacgttgcgatcgacctgctcaattccggctgcgatgtgatcggccagcacgtcgacacgaccgcgccgcaggtcgccgcccaggagaagggcgcgttcgcgatcggctacaacgcggccacctacgatgtcgcgccgcaggcgtatatgaccgccccgctgtgggattggggttcctattacaccgccgaggtgcagaagatcatcgacggcacctggacctcgcagaactattggggcgatatgaaggacggcattgtctaccttgacgagctttccgccaattgcgccgagggtacgcaggagaaaatcgacgaggcgtacgccaagattgaatccggcgagctgaaaatctttgccggcccgatcagcgacaacacgggcgccgagcgcgtgcccgccggctccgaaatgaccgacgccgagctgcttgcgttcgactggtttgttgacaacattgtcggcaccgtccccgccgcctaaacttttccgttccaccgaaggggcggggccatgccccgccccttcttttccctctcccgcccattcgccttttcgggcggcctgccatcagcaaaataaggaggttccaacatggattgcgcgccctatatccaactgaccgatatctgcaaatcgttcggcagtgtccgcgccaaccacaacgtctgtctggatgtcagacgcggtgaaattcacgcgctgcttggtgaaaacggatcaggcaagagcacgcttgtcaatatgctctccggcatctatgcgccggacagcggccagatcgtcgtggacggacgcaagcggcgcttcgcttcgccgcgcgatgcgattgagtccggcatcggcatggtgcaccagcatttcaagcttgtcgatgtgatgaccgctgccgaaaatcttgcgctcggcgcacgcggcgggctgtttgtaaataagcgcgcgctcgccgcgcggatgaaagcgcttggcgcccgctacggcctgacggttgaccctgagcgcaaggtttacaacatgtccgtcggagaaaagcagacggttgaaatcctcaaagccctttaccacggcgcaaatgtgttgatcctcgacgagccgacggcggtgcttacgccgcaggagacaaaaagtctctttgagatcctgcgcggcatgaaggcggagggctgctccgtcatcatcatcacccataagctgggcgaggtgcttgagatcagcgaccgtgtgaccgtgctgcgccgcggcgagtcggtcggcacggtcgagacgaaggacgccgacgcccgctctctgaccgagctgatggtcgggcggcccgtctcgctcaagatcgcgcgtcccgccgtcccccaggagctgaagcgcccgctgcttgaggtgcgcggcctttcggcgcgcgggccgggcggcatcaagacgctcgacggtatgagctttacgctctccggcggcgaaatactcggcgtggccggtatcgccggcagcggccagaaggagctgtgcgagatcattgccggtatgcagcgcgcttcgtccggcgagatcgtgttccagggcgaatcgattctcggcaagccgccggccgagatcatcaggcgcggcattcagatgagctttatcccggaggaccgcctcggcatggggcttgtcgcgggtatggacatcgttgagaacgtgatgctcaaaaccttccggcgcggcaaaacgccgtttatcgaccgttcctccggccggcgggacgccgaacgcattgtgcgtgattattccatcgacacgccgtcggtcagccacatcgtcaaaaagctgtcgggcggcaatatccagaaggtgctgctcggacgtgaaattgatctgaacccaacgctgcttataaccgcctatcctgtgcgcggtcttgatatcggcgcttcctattttatttatgacgcgctgaacaaacagaaggaaaagggcgtcggcatcctgttcatcggcgaggacctcgatgtgctgatggagctgtgcgaccgcgttatggtcatccatggcggcgcggttatgggcatcgtcgatccggcgcaggtcaccaaagaggatatcgggctgatgatgctcggccataaacccggggaggtggtcgcatgatccgcattgtacggcgtccggacccgtcgcgccggcgcgacattgtcacacgtctggcggctgtttttgccgcgcttgtctgcgcgtcgctgatcatggcggcgctcggctacaatcccgttgctgttttttccaatatcatcgtcggttccaccggtacggcgcaccgtatccgtcagaccattgtcaaggccatcccgctgacgacgctttcgctcggcgtggccgtatgctttaagatgaaattttggaatatcggcgcggagggacaattttatctgggcgctctgttcgcgacatggacggcctatcacttcaaaacgctgccggccggggcgcttctgccgctgatgtttgccgcctccctgatcggcggcggcctgtgggcgctcattccggcggtcctcaaatcgaaattccgcacaagcgagatcctcgtcacattgatgctcaactatgtggcgacgaaattcatcacgtatcttcagtacggcccgtggaaggacccgagcgcgggcggctttgccaaaatgcccaaattcgtcgacgcggccgtgcttcccaaactgttcggcgttcatatcggctggatcattgtgcttgttctggcgctggccgtccatatcctgctggccaaaacaaagctcggatatgaaatttccgtcatcggagaaagtgaaacgacggcccgttacgcgggcatttccgtggcgggcgttacggcagcggccgtgatgatcggcggagggctgtgcggcgcagccggcttcatgcaggcctcagcgattgaaaaatcgctgaccgaccagctctccgcagggcttggcttcacggccgtcatcacagcgtggctggcgcgtctgtccgcgccggcggtcgtcgtggtatcgctgctgttcgccgcgctgcttcagggcagcgcctatatccagacggcgcttcaggtaccgtcggccgtagcggatatattgcagggcgtcatcctgtttttcgttttgggcagtgaatttttcttaaattaccgtctggtgcgcacgcaaagctctgaaaaggaggcggtcaaatgagcggactgacgcaggtatctctgtttttacaggtcgccgtccagatgggcacgccgatcctgttcggcacgctcggcggcatcctgtgcgagaaatccggaaacatcaatctcggcgtcgaaggcatgatgctgatgggcgctgtgttcggctttatgacggcgctgcacaccggcaacccatttctgactatcgccgtcgcagggctggcgggcgcgttcggcgcgctgatctatgcggtcatcaccgtgacgctgcgcggcaaccacaccgttacggggctggcgctgaccatcttcggcacgggcttgtccggcacgctcggcaaaccgctggccggtctggcgctgcccgattcgatcctgcgggccttttccgcctacaatgtgccgggcctttcaaaaatccctgtgctcggcgaaatgtttttccagcagagcgtctatgtgcagatcgcgccggtgctcgcggtgctcctgtacatctatctgacgcgcacctgcgccggcctttcgacgcgcgccgtcggtgaaaatcccggcgcggccgacgcggccggggtcaatgtcacgcttgtcaagtaccttaatatcgtggcgggcggttttctctgcgggatgggcggcgcgtatctgtcggtcgtattcgtgccgcgctggcaggagaatatcaccgccggcatcggctggatcgccgtcgcgcttgtcatcttttccacctggaacccggccaaagccattttcggcgcgtatttcttcggcgcgctgcgcggcgtcggattcaagctgcaaaacgtgcagctcaatctctttggatttgaactgcgcgtctcggcgcagcttctcgatatgatcccgtatcttatgacaattgtcgcgcttgtgttgatcgtccagggcaagcggcgtgaaaatcagccgccggccgcccttggcaacccgtatttcagggaggaacgctgatatgtccgccgccctttccgggagcgtccccgcgcccgcgccatccatggcgcgggcgcttcatgcaccaaacgaacagcagcgcgccgtaatcggggatacggcgcacagcatccttctgcttgccggcgcgggaaccggaaaaacagatacgctcgcgcgccgtgtggcaaacctgatcgtctccggcgccgcggcgccggaggaaatcctctgccttacctttacaaaccgcgcctgccgcgaaatgaccgaacgtattgaaacggtcgcgggcgaagcggcgcgggacgtggccgtgcatacggtgcacagcttttgcgcgcgtatgctgcgcgagacgccggccgcgcgcacagatctcggacgcgacttcaccgtctgcgacgctgccgacgcgcttgagatcgtgcgcctcgccgtcgaacgcacgctcggccgggaaatcgacgggcgcagcgcgcagattcttcttgattttatcgggcttgtcaaggacgccatgctcgaggacccggcgcgctcccacgccgaagccgcagccgccgtattcgtttcccgccgcgaacaggccgaacgtatctgcgtcgacgaacagcgccgctatgacgaaaagtttttccgttttctcgcgaaatacggcgcgtccgtcgcgcgcctttacgatcagacgcttttggagaacaacacgctcgatttctccgacctgctcatccgcgccgcggccctgctgcgcgacccggaaaccgcctcgctgtggaccggccgctttcgctttgcgcacgtcgacgaagcgcaggatgtcagccttgcggaatacagcctgctctctcgtctgtgcagcggcgcggtcacactgttctgcggagacttcaaccagacaatctacggctggcgcggctccgaccctgccgcgctcgccgcgcgttttgaggcggaattccaccctgtccgtgtggaattcacgatcaattaccgcagcagcggccagcttctcgctgtcggccaaaacatcctgaaggcagcctttggccgcggcggcggcagccgcttcagcgtttcctcaccgcagtgcaccgatatcgcggtacgcgcctttgacacgcccgaagcggaagccgcctggattttagagtcaattgaatcgctcgggttaaccgactacacgcgcgcggccgtcatcgcgcgctccaactgggcctgttccgagctgtgcgaactgctctgccagggtgcgcacgcagcgcggtcgcccgtccgctttatgctcgccgacgagctgcgcctcttttcacgcgccgaggtaaaggacgcgctcgcctgtgtcagcctgcttgccaatccgcgcgacggcgcggcgcttctgcgcctgctgcgccgccatacagccggcgtcggcgaagcgacggcgcgcgcgctggcggccctgccgcgcacggacagcggcgcgctcccatgcgatctggccgatctgcgcacgcaccgcagcggcgactttttcgtcggtctgctggaggcgttttacgacggacgcgtcgtcgtattcgatgtggaaagcaccggcgccgacgtttacacggacgatatcgtacagatcgcggccgtccgcctctcgcccggcggcggcgaagccgcgcgtttcgaacggttcctgcgtccgtcgcggcctgtcggcgcgtccgaacgggtccacggcttctccgacgcgtttctggcggaaaacggcggcgcgccgcgcgccgcgctcgaggatttcctcgacttttcggaaggctgcgtcctggtcgggcacaatgtgacattcgatttgacgatcacttcccagaaccttgcgcgcacgggcagcgtgcggacgctctccaacgtctggtacgacacgctcgatatcagccggcgctatttaaaagagctgcccaatcacaagctgtcgaccgtctcggcggcgctcggcgcggcgcacgacccgtcgcataacgcaatggacgatatccttgctacggccgatgtgttatccgcgctgataacacagtatgccgcgccgtatgagacagcgcgccgcgcggcctatgaaaagctcctgccgcgcctggaaccgttcgcgcgcctgctggcggatgtccgcgcaaaaaccgccgcgctcgccgcgcccgaagccgcgcggctcgcctgccggatgttcgggctggaggaggcgttcgcggcggagccggcgcgcctggcgaatctggagctgttttttgacgcggccggcgattataccgaccgcacgcagccgccggcgcgccagctcgcctcgctgctcgagctggcggcgctttcgccgggcgcgcttgaccgtatgcgcaagaccgccaacaaggtcgccgtcatcactgcgcatcagtcgaaggggtgcgaatttgactatgtgtttttgccgatgatgcaggagggcgtattccccacctggcaggcgctgcgctccggcgcgcttgacgaggaggcgcgcgtcttttatgtctcggtcacgcgcgccaaaaaaaagctgttcgtatcctgggcgcgcgggcggcgcgggcgcggcccggccgggccgagccgttttctcgccatgctcggataggcgggcaaacgagcggataagcgttccataagcggcccgcgcctgtgcggtaaatctgttttccgaactgtcgcaatcttgctaaaaaatagtcattatgatataattggtaaaaatatgggcgttttgtgcaagcgcctgaaggaggggacttttagcaatggcaatatccaagtgggatgtatcggtcaacggaaagaatcacaccattgagatcaaacgcggcttaggcgcgctcaaggttgttgtcgacggacaggttgaaaaggtgcgcagccagaatttctggatcatgctgcttgaccgtgaaatcagaatcgaggacaaggtgctcaaccttgtgatgatcgggagcaaagctgatctcgctgtcgacggcgtgtatctcggctccggtgagaagtatgtccctgtcggcaagacgccggcctgggcctgggtgatgaccgctctgatgctgatcctcggctattttttctcgggaatcatcggcctgctgatcggcctgcttggcagcacactttgcatctcgcgttcgctgcgtgcagacggcaaaaatacgcttccgatttgtattgggattacaatcggctgcatcgctgttcaggcagccatcatgtttttggtcgcggcgctggtatattaaggttttacatatgcatatcaaacgggccgccggcataagccggcggcccgttacgctttttcccgcgcctgacgctgctttgtcagctcaatcgcctctttgccggtcagatgctcgatggataattccagcatacacacccggtcaaactgctggtcgatctcctgccggcggccctcggcctggtcaggcgaatacttcgcggccagcaactccagcgcatgcagcttttctgccgggtcctccagcacgcgcacgcgcccgaacgcaatggcgcttcgaaagcaggttgtatacttttccggcagaacatgatcctgcccgatgacgcagaacgacgctttcggatgtcttttgacggcgtccagcttgtggccggtcacggcgcagtgaaagtaaagcttttcgtcgtaatagacaaagctcaatggaacggcatacgggtaatcgccgtcgcccaatacggcaagcacgccggaggtcgcccgctccagcagcgcgacgctttccccgcgggaaagctcctgtttcttgcggcgcatttctctgaacatgcagtcatctcctttataaatatattttatgataccgcattgcgtacctgtttgcaaagccctgtggctgaaaacgggcggtccttaaaaaaggaaccgtccgttttcagccattgtttacgcaaatctatcttttgtttattcgatgcgtcctgtgtcggcgggcagccggaccgtgacggccgtgccctcccccggcacggattccagcgtgatcgagcctccatgacgctcgacaacgtgcttgacaatcgaaaggccaagccctgtgccgccggtctgcttggagcgcgattgatccactcggtaaaaccgttcaaatatgcgctcctggtgttccctcggaatcccgatgcctgtgtccgccacccgcagacaggccaacccgtcctgaactgataaagacacatcgacgcgcccgccctgccggttgtatttgacggcgttatccaccagattggtaatcagctcgtcgagcatctgccggtcgccgcgcaccggcgcgggtcctcctgtcaccgcaatttccacctgcttttgttcggcggtgaaacgcagcgtttcgacggcgcggtcgcatagcgcgcgcagctcaaccgggacattctccgtcagatcggcacgttcgatgcgcgacagacggatgatgtcgtccgtcagcgcaattaaacgctgcgcctgcgtatagatacgcccggcaaaccggcgcacatcctgagaattatcggccataccattttccatcatctccgcgaaaccggaaatcgatgtgagcggcgttttcagttcatgcgacacattggccgcaaagtcgcgccgcacctgttcggcgcgctgctgctccgtcacgtcgagcagcaggacaatcgccccgcagatcgcaccgcccgcgtcgcgcaccgggcttgcaaagatatgacatgcgcgtccgtcccgctcaagcacggcgtcggccgcagcgccggcgagcgcctttcccgcacagtctccgagcaattcagagcgggagaggtttaggatatttttaccctcatatacgccctcggccgcatcaagcagcataagcgcgctgtgattgacagagaggataccgcgttccaaatcaagcagcaccatcccctccttcatattggaggtgatcgtgttgattgtgtctcgctcctcgcgcagccgtttgacctgctcctgaatcaaccggttctgctcgcggatcttggcaaaaaacggctccagctcctcataggccgcaccgcgcgcgccctgctccagattgtcggccagcgcctcgatcggacgcagaagccggcgcgtcagacgtgaggaaacaaacaggcagattgcaatcgccgcggccacaatcaccagcatcaccggcacacccgccgcaaacgccgcgccgacgctgcgcgtctgcttggagacgcgcagaaccgtgccgtcagacagcctgcccgcataataaaccgtatccatccccattgtatcggaatggcgcacatcgctgcccgtcctgccgtccagcgcggccgcaacctcgggccgttcgagatggttttccatcgacgcgctgtcattgtccgtatcgaacaggacggtgccgtcgggtgaaatcattgtaatgcggaagctgtcaaactgcaatccgagcgactgcaaatatgccacctcatccggccgcgtaaaatcgatggagcgcgcgaccagcttgaaatcgtcggccaaatcgcgctgcgcctggcccagcaaaaccgcgtaataggagcggagcgtcagcgccgccgtcagcagtaccatcaatacagagatggagcagagactccaaaagacccgttttttcatcttgattgtcctcccggcggccctttaatcgccaattttatagcccacgccgcgcacggtgcggatcagctccccgcagggaccgagcttttggcgcagcgatttgatatgcatgtcgactgtgcggctttcaccctcgtagtcgaatccccaaacgcgttccatgattttctcacgcgacaggacgatgccctcgtttttcatcagatacgcaagcagttcgaactccttgaaggtcagcgtcaccgcctcgccgttggccgtgacaacgcgccgcccggcgtcgagcgtgatgccgccgcagcggcagagcgcggcggcggcgtccggccgcgcgcggcgcaaaacggcccgcacgcgcgaaagcagctccataacgccgaacggctttgtcacataatcatccgcgcccagatcaagcccgcgcaccttatcgtattccgccgccttagccgtcagcatgatgaccggtgtgtcggacaaacgcgccgaagccttgagccgccgcagaattgtaagcccatcctcgcccggaagcatgatgtccaaaagaataagtcccggcgtttcaccctccgcaagcgcctgccagaactgaccgccgtcggcaaagccgcgcaccgcgtagcccgcgctttcaagcgcatagagaaccagctcacggatgctctcgtcatcctcaatcagatagattgccgccgcctttgccaaatggcatccctccgtttccctttggcgagcgggtattaaatgatgcgttcgttgccgtgctcgcccgtgattgaaaagacgacccattcggctatatttgtcgcatggtcgccgatgcgttcaaaatatttggccaccataatcaggtcgatggcctgttcgccgttggcggaatcggcgcggattaagcggatcagatcgtccttgacctgaacaaacagatcgtcaacaatatcgtcgcacgcaatcactgcccgcgcgcggtcgaggtcgcgcgcgacaaaggcgtcgatggctcccgttaccatccgggtggtcgcatgcgccatcgccgggatatgctggagagaatcgatgtactgctcgtcgatcaggcggatggtaatctccgagatatcctccgcctgatccccgatgcgctccatatcggtgatcattttcagcgccgtggaaaccatgcgcagatccgtcgcaacaggctgctgctgtagcaggagccgcaggcagcggcgctcgatctgtttttccttgtcgtcgacaagcccgccgtgttcaatcgcctttttggcaagctccaaatccttttcaagcaacgcgcgcgaggcgtcgccgatggctctttcgatcagcgcgcccatctctatcagttcattgttaagctgttcaagctcctggtcaaatcgatttctcatatgcctttccccctttgggcttgtttgaaaatagaggaattgccggtttttcaaacagcccctagccaaagcggcccgtaatatagtcctccgtgcgtttgtcgcgcggcatcgagaacagattgtctgttttatcgaactctacaacctcgccgagcaggaaaaaagccgtctcgtcggagacgcgcgtggcctgctgcatgttgtgcgtcacaatgataatggtgtaatcctttttcaattctagcacaaggtcctcgattttagaagtggaaattggatcgagcgcgcttgtcggctcgtccataagcagcacctcaggctcgaccgccaacgcccgggcaatgcaaagcctctgctgctgtccgcccgaaagtccgagcgcgctcttttttaaccggtccttcagttcatcccagatcgccgcggcccgcagcgattgctcgaccagctcgtcgagcctcgccttggagcggatgccgtgcgtgcgcgggccgtaagcgatgttgtcgtaaatattcattggaaatgggttcggcttctggaacaccatgccgacgcggcggcgcagaaggtttacatccatgccgccgtagatatcctctccgtcgagcgtgatttttccggtgatccggcacccctcgaccagatcgttcattcggttaaggcttttgagcagcgtgctcttgccgcagccggacggcccgataaacgctgtgatcgtgcgttccttcagagccagattgatatttttcagggctttgaaatccccgtaatacagatcgaggttttcaatcgaaaattttgtgtccatcccgtttcccctttatcctttcgtcagacgtctggcgatcaatgccgacagcgtgttgatcagcagcactgtgatcagcagcacaaccgccgtggcgtatgcctgattcgtatacagcgcctcgcttgaaagcgcatacatatggatagccagcgtgcgcccggacataaacagaaaatcctttcccatcggaatctgcgcgaccgtaccggctgtatagatcagcgcggccgtctcgccgacaatgcgtccgacagccagaatcacgcccgccagaatgcccggaacggcgcttggcagcacgatgacgaacaccgtgcgcagcttgcccgctccaagtccgaagcttgcttcgcggtatgggtcggggacggatttgagcgcctcctcggtggtgcgcatgatgagcggcagaatcataatggccagtgtaaaagcgcctgaaatcagcgaatagccccagtgcacagccgtcacaaaaaacagcatgccgaacaggccgtacacgatcgatgggatgccggagagcgtctccgacgtcaggcgcaccaggccgacgagcttgtttccgcgcttggcgtattcgaccagatagacggctgtcaggatgccgagcggcgccgcgatcagaagcgacagcagcgtcatttcaattgtggtgacaatcgcaggaaacagcgagacgttttccgtcgtgtattcaagctcaaacagcgacggcgtcaggtacggaatacccttggccagaatgtacacaacgatgaacacaagcatgcagaccgtgatcagcgccgccaggcagaccagcagcgcgagcgtgagcgaaagcgggtggcgcagatatgattttatgcgctgtccggcgctcattcggttgatcgcccggatttttttaagggtggattttgccgtctccatcaatccatcctccttttgagcagcgaaaacgaaacattgatcagaagaataaatacaaacagcacaacgcccgtggcgatcagcgcctcgcggtgcagccccgtggagtagcccatctccatgacgatattggccgtcagcgtgcgcacacccttgaagatgctgtccgggatgcgcgcctgattgcccgcgatcataacgacggccatcgtttcgccgatcgcacggccaataccgagcactacgcccgccaaaatgcctgacttcgccgccgggagcacggcgaaaaacaccgcgcgctcatgcgttgcgccgagcgcaagcgcgccctcgtaatagctgtccggcaccgcgcggatggctgattcactcacgccgacaatcgtcggcaggatcatgatgccaagcagaatcgaagctgtcaggatggtgttgccgttgctgatcacaccgaacaaacgcgcgaatttgcgtatgaacggcaccagcacaacaagtccgaaaaagccgtatacgatcgacggaatccctgccagcagctcgatggcgggcttgagcacccggtaggccggacgtgggcagaagcgcgccagaaacaccgccgttaaaatgccgatcggcacgccgagcaggatggcgccgcctgtgatatagacgctgcccacaatcatcgggaaaatgccgaacgacggcggcacatcggtgggcgcccatttgcgtccgcccaaaaagtcaaacagtcctatttttgccatcgcgggcaggccgtttgcaaacaggaacacgcagatcagcagcaccgcgaagatggacgcgagcgcacagatcaggaacaaaagctccatcaggcgttccttcaaattatatttcttttgatttgttgtctgcgccataacacacctcgtctcccagtcaagggcgggttttcctcctgacagccgtaaggggcggattgttacatccaccccgcacagctttggagaaaagaaagaaatgaaaagctccgaattggagaggtcggtcgtttcttactggagcagcgcgtcccaggcgagcgtttcgcctgtaaagacgctcttgacctggccgctggtcagctcgtcaagcggattgcccggcgctacgaccacggcgatgccatcgctggcaatcacggtcgcattgagtgcggcggcttcatcctcgctcaatgcacgcgaagccatgccgatatcgcaggtgccgtccatcgccgcggtcatgccggcggtggaatcgctcgtctgaatttcaatggcagcattcggattgatcgccgtatacgcctccttgagcttctccatcaccggagagacagaggaggaaccagccacaacaattttgccctctggctttgttcccgcaaaagcggcggccgcatcgtcgaccttgatataaccgttatcctcaataacctgctggccctcggcgctcatgatgaaactcataaaatcctgcgcggcctcggaggcatcgccctttgtcgcaacattgaacggccgcgaaaccttatatgtacccgctttgacgttttcggcagtcgcctcggcgccgtcaattttgagcgccttgaccgtatcgttgagggaaccgagcgaaatatatccgatcgcgtacggatcgcccgcgacattcgtcatcataacatctgtcttattggcgataattgcctcctcggttgtgtgatcgaccttgttgccgtcagcgtccttctcctcgatcccaaacagctccacaaacgcgccgcgtgtaccggaacccggttcgcgggaaacgactgtgatcggcatggcggcatcaaaatccgaagcggccgctggtgtcgacgaagctgccggcgccacgggcgtagaagccgcaggcgcagtggtggaaggcgctgcggcggcattgtcgccggaagaaccacagccggccagggctgctgcaatcataattgttgctatggaagcgcaaagatatttcttcatttttttcacctttcttatgccgccgcatatgcattttgcggctgatcgttcctgtctggtacgagccaaagtatagcccacgtttgtaaagctgcaagcgtgccattgtaaagtctgtgtaaaatcgcatgtaatccgcccgtataactgctaatggcgatctttttgacccattctttacagtttattttctcagctctgtagccggcgcaaaaaatgatgtccgtcatccgtctttttattaaaaaaagggttgcatttctcaaatacacgtgctataatagtaaagcactcaaaaacagtgcaaaaaagatcgcggggtggagcagtccggtagctcgtcgggctcataacccgaaggtcgtaggttcaaatcctgcccccgcaaccaataacccgctgaaatcgtctgatttcagcgggttttctttgcttttcagaatcccctgtcggttcggtatgttatgaaggtttcgctgaccaaatacctcggctaaaaaacatttatcacatccctttcacgatttccataaaccgctccagagaataggcccccggatagtccggctgcttgctctcaaacaccatgtaatacttgtattgttttcctgccaatccagcccactggtcaccgattttggacttttccttggattcatcgttatccaggtggtcgcccttggtctccaccatcagaacttttccgctgtgaagcatcacaatgatgtccggatacgcatggacagggccgttgatctgaaaccccaagcgggaaatattgcggtgccaccacttgacattttccagttccgacagcgcccacgccaccttgaactcgtactcgttcatatcttcttcggcggtataaagcgattttggcaccatcgaggtaaaggccgtgggggaaatcaccacaggcagcgcatagttgggcaggcaggaaatcttgtcctgttccagccaggtatcaaagacactggaacggtgctgggcaatcaattccttcactttcctctgaatcttcacaacatagggatacggcgactgctccagctcagaaagctgatctttacccatcgtgccgatgacccggtcgatatactcatccagttcccggtcgttgacgcagttcatcttggacagcttttgcttgataatgcctttgcacagcgagagccgcttttccgagggctgggtgttgaaccattcccggaaaaaggcactgtcgccgccagacagccgccacgcctttgcggtgctgtccctgctgtcatctacatccacccgtgccatctcagcgttgaccgtggtgaaatccacatgggcgtctttagagcgcagagaaaatccgccctccaaatgctccagttccagggtctcgtaggcttctgaaaacaggctgggaccggtctccagcataaactgcgggaagcgcagggcagcggcttcgcctgcaaattcctcattcattcggaactgattcattttgtcgcgcacctccgatggagcctgactcaaggcggtattgtcggcctggttgttctcgtcctcataggttttgctctgttgcagggcctgtgacagcatagggtcggcctgcacagatccatcctgcacggattgctccgcctcatgcgctgccgctttaaaacgcgccttcaaatctatgccgtccacctccggcagatccggttcatcggcgggaggcgggacaataggaagctgctccggttccggggcgggaggttccataacgggaacatctacatcctgcgcccggtagtcgcggcggctgaagccggcgctgttcagcccggctacgaccttctccagcgtctggcggaagtctgcggaagatgtgatgacataggaaagatttagaacctcgctgtcattcttctgcgtgtagggcaaccgaagtacacgccccagaatctgctccacatccacagtagaagtgcggtttgccaccgtggccaacacataggcaaaggggcagtcccagccttctttcagggcgttgacggtgacgatgtaccggatggggcagtctggggacagcaagtccacatttttcagctcgtccttatcgccggttttgatggcgatttccttttctgggattccgccgtccaccagcgttttcttgattttttcgtatgtggtgctgtccgcgttgttgcggggctgcgcttgaaacaaaacgatgggccgaatatagcgcccgctggtttcctgctcccgcttagcctgtgcctccagcttggcgcggatggcgatggcgtccccatacacatccgcctgagacctgcggttatagacgatgaccggcagcttgaccatactggcctttttcagccgtgcggcgtccacaaaggaaatgatgttgctgttctttttcggtgtggcagtaagatcaaacacaaaactgggattgaagttttgcagcatttccacgctcaaatctgaggtggcgtggtggctctcatccacaatgaccaccggattcagatagcggatcacctggatcagcgccgtctcatcggtatcggccagcagaaccgacggatcatccatccacttggcaaactcggccagataaccattctcctgataggctttgcggccttcctttttacttgtgcggaaggaatcatagctgagtacaaacaaggaaagctgttcggtaacggcggagggggtgaagttttgccccatgagggcctgctccttggagtacacctgcacccgcccgccaaagtccacatccagccgctgccggtagggatggtctggattttccagcgccttgcgggtctgggtcaaaatggcttccgagggcaccagccacaccacagccttagcccggcgctggggcatggcgtcaaaaatcgtccgcagagaactggcagcgatataggtcttgccgccgccggtgggcaccttggcgcacacatggggcacgccggggagaacattcacatagttcggcataccgtcgaaacccaccagaacattcttttcgttccagagggtctgatacgcctttgccgggctttgcagctccaccaccagctccaggtagcgtgcaagatcggcaatgacttctttttgataggatttcagttccatttcttcgcgctcccttacagccgggcaatgtcccgggggattttcttaaaggtgatgttgtggaggcgcagcgtctcctgtgggatggcgcacaggtcggcatagatggtgtagccttcggcttttgtctggatggcagacaaaaaggcatagtccagcgtggtgacgctttcccgctcatagtagaagtaataggcggtgttgcggcacagtcccatgaaatagggctcgtccgcgggctgtttggcgggcaggggctctttggtctccatatagtagacatattcccggattttctgcacgcccacttcttcgttgaggttgccgtccggtaacataagcacaggccccagctcataatagctgaaattgccgccggtgccttccacggccttcttgtcctctccatagccgtcaattacccgtttaacacgctcggcggtgatgctgtcggcgtagtccatcatctctaccagaatgaatctgcggttgccgccgtcagctttgttcatgttgagcacggcgtgggcagtagtgcccgaaccggcgaaggagtcgagaatgatggaatcaggatcagcggcaatttgaagtatgcgctctattaagcgcataggctttggagtggtaaatatttcagattcatgctcaaagattcttcggatttcttgttttgcatctgcattctggcctgcatctttatacgaccacaacgttgtgggaactacaccctgcttagcttcagaaaggaattttttaattcttggaacgctgtctccattttttccccaccaaattcgcttgtcagcatcaagtgctaaaaatgtttcttgtgatactctccaataagtcccagaaggcggtaaaaatttctttcctgaaggtgaaatgatctcataacttccttgagcataatagtttcttgcttgaactgcattagtagtccaaacacctctagggtcattatcaggattggtgtaactattatcaagatctaccgttcttggaagcaagttccggtgaaattgagacttattttttgaatagacaattatatagtcgtgcatcccggaaaaatactgtgctgaattcttaacggtatatattttttgccaaatgatcgtatcaataaagttgttgtcgccatagatttcattacaaatcatcttaagacttgcattttcatcatcgccaatactgataaaaatagctccatcccctgccaacagccgctgcaacagcttcaaacgggggtacatcatacacagccacttgtcgtgccgggaaagatcctcgccctctttgcccaccacttcgcccagccactttttgatcttggggtcattgacattgtcattatatacccagccctcgttgccagtgttgtaaggaggatcaatgtagatgcactttaccttgccctcgtaccggggcagcagggctttcagcgcctccaaattgtcaccgtggatcaccatgttttcactgccgttgtcctcggtgtgccgcccagcttcgtcatagctgtactggcgctccagcacccggtaaggtacttcctggtggtggtttaccaccttgtcttttccaatccattcaagcgttggcatagggtacgtcctccggccgatttatgttcttttcccttttactctaccacattcctccaaaacccgcaaggattcccgcgggactgccagcaacagaatagcggtttcgccttttctttgtttaaaatggtatcgggcttttcaggggttttttcacctcgaatttcacaggtaaaacaaaagatccaaacgggggattctcagaagctggctggattcgagcccccaaattctttagaaagctacagcgccctttttgaaattggatttttcaaaaagggcgctattttcatatccagcaaaaattggaagagaaagcaggagttttagcaagaaaaactaagattatattgggaggaatgattccggctttttttacaaaatcgaaaatttaaaattgtcagatatgtggaattgaagaaaacatcttgacttttggaagatatattatcatactatgatatagcatctaaacaatattgagaggagcttgatttatgaaatatgattttcagacagtcgtggaccgccgaaatgtaggcgcatttaaatgggaagaaatgagaagaacagatccgactgtgggcgatgatattgtcccgctttcggtagcggacatggaatttaaaaatccgcccgaaattatagaggggctaaagcattatctagatggcgcagtgctgggctatacagagcctactgagcagtatttgagcgccgtctgtggctggatggagcgccgccacagctggaagattgacccggagtggattgttaccacacctggggtggtgcctgcgctgtatgcctcggtgcaggtattcacacagccgggggacggcgtgctgattatgacgccggtatattacccattctatgaagccatgaccatcaacgaccgccgtgtggtaaaaacttcgctgatcaataatggcgggcggtatgaaattgattttgacgactttgaggcaaaggcgaaagaaccctctgtgaagctgctgctgctgtgcagcccccacaacccggtgggccgcgtgtggacgcgggaggaactggaacggatcgggcgcatctgtgttgacaataacgtgctggttgtcagcgacgaaattcattttgacttggtgatgcccggttacaagcacattatgtttggctcgatcagtgaggaatttgcacagcactccatcgtgtgtacagcccccagcaagaccttcaacctggcggggatgcaggcttccaacatgattatcgccaatgagcagcttcgggaaaagtttgtggcgcattttgacgcggcggcgatttactatctaaacatcttgtcctacaaggcgtgcgagattgcttatacccaatgtgaccagtggctggaagaactgctgggcgtgatcagggagaaccgtgattacgtggcgggatatctggccaagcaccatccgcaggtcaaggtgacaccgatagaggccacctacctgctgtggatggatttccgggcactgggtatggataatgaggcgctggaggccctgatgcagaaggacgcgcgtctgtttctggacgagggctatgtgttcggcgaagatgggagcggctttgagcgaatgaatttggcctgccctaagagcgtggtggaggccgccatggcaaggctgaccgcggcgctggaaaagcatgggagataaaagggaggaaccagaatgaagcggtatgctatcatcggtttcggctgcgcgggttattccgcggccaaagcaatccgaacgcgtgagaaagagggcgagatccatgtgtttgaggcgactcgcgaggcgcccgcgaacccgatgctcaccacctatctggcctctggccgcatcacggacgatgcggcccaccccttcggcagcaatctggagcagattggccgggaactggggctgacagttcacagcggcgtgagggtgcacagggtcgatgcagccagaaaagcggtggtgctggaagacgggaaaatggaatttgacaagctgctgctggctactggcgcgcaggcgttctgcccgcgtctgccaggcctgccggacagacgcgttatggtgatgcgcacaatggctgacgcgcgggggctgcatgattacctgaacagccgctcagtggaaagggcggtggtggtaggagcttcgatggtgggaattaaggtggcggaactgctgtggaggcgcggcattgaaactaccgtggccgacgcagcgccgttcctgttcccgctggccgcatttgaaaatgtggcgcgttttctggaggggcaggttgcggcccagggggtgcgattcctgtggaacgcggcggcgcgccaggtgctgccgcagggcctggagctggcggacgggacgctggtgaaggccgacttgatctgtctgtgcatcggtacgcgcgccaacacgaagctggcggagaacgaggtggtcatcaaccggggcattgtggtggatgatcacatggctaccagcgtgcccggcatttacgctgccggggactgctgcgaaggcacagagctgcagagcgggcagaccatgatcattggcctgtgggccaatgcgaaaaagcagggcgaaacagccggagtgaacatggcgggtggagacgcccgctatgagggcaatatcctgcacaatatcacccatttcatgggcctggatttcattggcctgggtgacacccggcgcgggggaaggtctgtttcctggggagatatgaggtgtgggaattatatccaggctgtcttgggtgccgatgggaaaatccaatgcgccaatattctggggaacctgacggctgcgggcgtgctgaaaaaccatatgtacaaagagctgagcggagaggcgaacgcatttgggccggtggaggctgcgctgctggagcgcagcggcgttccggcggcctttgtgcgccaactgggaggagagtgaagccatgacggaacaggaacggcttttacatgcaaaaatcccctgcgaacagaccggaatcgaggtgcgcaagagcttgtgcgccatctgcactggaatccactgcgggattgacgcatacgtgaaggacggtaaactggttaaggttgagggtacggaggattacccggtcaattttggcaagctgtgtgtgaagggtgccggcacgcgggggtatgtgtaccgggaggaccggctgaaaaccccgatgaagcgcgtcggtgcgcggggcgaagggaaattccagcccatcacctgggatgaggcatacagaaccatcggagaacggctgaatgccatcaaacggcaggatgggccggaggcggtggcctgggtgacggggtttaccaagtggcaccgcccctggatgcaccggctggtgcactcgttcggcagcctgaattacgccaccgagagcagcgcgtgctaccgttcgatggtgatggcttggcaaacggtgaccggccgggagtacggctgtgacctggagaacagcggcctgttcgtggggtgggggtgcaatgccttccacaacgcctatccattcggggaggccctgcgccagttccatgacgcaggcgggaaaatcatcatcatagatccccgcgtgacggacacggttaaccagctggcggacctgcacttgcagctccgcccaggtacagacggggctctggccttggggcttgccaattatatcatctgtcagggctgggcggacgatgcgtacatcaaagcctatatccacgggtttgagcaatttgcagcctatgcggagcgattcacactggaggagacccagcgcatcaccggcgtgcctcaggaactgatccgccaggcggcggaaatgtatgtgaccagcggcccggtgagtacgtatcagcctgccagcgcgctgtcccatcatcgaaacggatacaacaatgtgcgggcggtgattgcgctgcaggcgatcaccggcaacctggaccgggaaggcggcgaccttccggtccacgaaacctatctctacacagactgcgggttcgacatgaaggccggggaatttgtacaaagccagcgccccgccgcgtgtaaagggcgaatcggcgcgggcagattccccgtgtgggacgcgctggcggatgagttccagtccatggatctggcgcgccagatcaccgaaggcacgccctatccggtgaaggcgatggtggccatcggtgtgaaccatcggatgttcccgcagccccatcagcagctggaagcctatgacaagctggacttcattgtggcggccgacctgtttgagacggaattgtgccgccacgcggacattgtgctgccctgctgcacctccttggaacgcagcgaactcaaaggatatgagggcggtttcctcacttgcaccaccccggttattgagccgctgtaccaatccaagcatgatgcgcagatcctctgcgaactggccaggtatctggatgtggacgacagcctgctcaatgccggctacgacgcgacgctgcgctacctgatccatggtaccgggctgacgctggaagaactgcggcaggccccggcgccgctggaagtgcccaatcagcgcccgtatacgcccgggtattatctggaacatgggtttgaaacaaagacggggaaaatcgagctttactcggaactgattgccggaatgggcaggccggatttgaagcccctgcccgtgtatgaggacggcttcggcgaagaaaaggacccgcgatatccctttacattggccaccggcgcgcggttggcccacgcggtccactcccggttccatggggtggcctgggcccggagcctgcggcctgaccctatggtggacatccatccccaagacgcccagcttctgggtgtgcaggaaggagactgggtggaattgttcacgcctcacggccaagtgcgcgtgcggactcatctcacggcggggcagctgcggggagatgtggacctgtaccacggctatgcagaggcagatgtaaacgagcttattggccgccagtatctggatcggtacacgggctttccgggataccgccagatacgctgcggcatcagaaaggcggcggtccaatgaaatatttactggacctggatatggacaagtgcatcagctgcggcgcgtgcgcagtggcttgcatggatcagcatgacacaaacctggagcacggcgacccggcgttgcgctgggtcgcccggctggagcggcagcagggggagcgggttgctttcctgggcctgtccatggcctgtatgcattgcaatgacgctccctgcgtgacagggtgcccggtgggatgcctgcacaaagatcccgaaaccgggatgacggttgtaaacccgacccattgcatcggctgccacagttgcgccatggcctgtccttttggcgcgcccaaattcgaccctcaggggaagattgtcaaatgcgacggctgtgcagaccgggttcggcggggatatccgcccgcgtgtgtgagggtgtgccccaccggtgcactgacgctgcgcaccgaggaggagcagaggcggcagaatcaagcacatctgctgcggcacgtgctccaattaacagaagatgcttgacttccttccagtttatggcctatactatataaaaaggctgggatggaaagaaggaaacatgatggcaagagggcttggttcagaaagcttgcagtctacatttgaaaaattaagcgcaaaggcggacagcctgtataagtttgtggtgatgtacaacgattacatcggtgaggcgaaggactatgggacaggccgctgtgtgaccatgcgcgaggtgcacctgcttacggcgattgaagaaaacccaggcactacggtgacggagctggccgaaatttggaaccgaaccaagggggcaatctgccagacggtgacaaggttggaaaaagccgggtatgtgctgcgccgcaaagagggcggcgataccaaaacggtgcacttgtaccccagcgaggaagggataaagctgagcaaggcccacaaagcctatgacatggcggagctgatgaaaactttgcagaacctgttgaaacaccacaccacggaggaaattgatgtgttttaccgggtgctggctacctatattgagctgatggaagaggatgggtaatcatcgccgcgcggcagagctgccgtgtatggaaaacccgtggaaggcgcagataatgcgtcttccacgggtttttttagaggttattgatttagtgggaaaatattctgataaattggcagagggggaagttctgccggccgggaaaggaacacgtccgccaggaagcgcaggcttaaaacagaatcataatgaattagatattaaatgataaaatgattgagagaagaaagagggagatcgctcctgtcggctgattttacagtgaaaccgggactgctgatgcacaaaaacacgatgaaaatgatgtatgagcggaatgtttgatgggatgaaacagcttggcaatatagaattccagaaggaaaaattagaaaattccgcccttattatttagcgactatactatatgcataaagtaaaaaaacgaattttggagaaaaagtagaacttcattttttcgcttgggaaagtattgacgcaagcggatcagatgattaaactaatatttagcagctatacaaaatgaagttcaaaggagcggtcaactatgagtgaacgggcaaattcggccgttgtcagcactgcgccgacaaccaaagatctgaagcgtgttcttgggaggaaagaactgatgagcctggcgattggtcagatcatcggtgcgggcatcatggcgctgatgggagccgccattggtatgactgggcgcagcgtgttttatgcgttcctgctgtctacagtatttgttgtgatcgattctctggggtcgatcctcattggcgggacagtccgtctgcggggcggtgactatactaaaatggcggctctggtgggcaagcgcacagcgggcgcctatgtgatttgtgactttatctggaacatcggcatcgcaatcctgcccctgagctttgccgactatctccagtctctgatccccggcatccccatcaaggccacggcgctggtggtgctgacgcttttcttcgtcattaacatcttcggtgtgaagcaggcggctttgattgaaaccatcatgctggtggtaatgggcctggcactcggttcgtttgttgtgttcggtatgccgcaggttcaacccggcgcgttcggcggtgtgtccaactatctgctcaatgggcctgtgggcattatcagcgcggctgcattcctcacatacgccacgtccggcagcttcgttgtcatctcctatagcggcgagtgcaagcacccaaccaaggatatcccctttgtgttgattgcatccacattggttgtggccggcatttacgctgtaatctctattgtggccgcgggcgtgctccccattgagcaggtggccgatcagtctctggcgctggtggcgaaaaaaatcctgcctgaacctctctttatcttcttcattgtaggcggatgcctgttctcgctggccacaacgctgaacgccacgtttagctggattaccaagagcctgctgcaagcgtccgtggacggttggttccccaaaaagttcggcactctgaacaagcacggcgcgccgatttatatcctgacgatgtactatctgttgggtgtggtgcccatcgtgtttggatttgacattgagttcgtggcggattttgcgctgatcctgtcgtatgccttcaacttcgcgttctcctacgcgattatccgcctgcccaaagtgtttccggaacagtggaagcgttcttcgtaccattgctcgaacagtatgctgtgggtttgtgctgcgctgactgtgggtatgtcagtgctgaacatctgcatgttgggttcggatttaaaccccgtgatgattatcggcaatatcgcttccctggcttttgcctatatctatgcgttcctgcgggaaaaacatgtggatatggaagtcagttacgaggatgactgaacaagatgcagaagaacggctggctgtataggcgcgtatccataaagaatgttgtaagcagccttatcttcttattctccggcagatcggagatagagagatgaacgattatccctctgactatgtggagcgtaaccggctggacgctttctgtaaagcggttcttcgcaacggggtcagatgctgcctgttggagctggcgcggtgctgcgaccgggaaaaacctatgggataccttgccgcaggctgaaatggacgactgcctcagcaacagctttgcgttttcggtttttggctataacctgcatacccgggacagattggcggcggggttctttgccggcctgccggatcaaaagcccactgaaatcatgtgatttcagtgggctttctctgtttttcttcggttttatccgcccctccaaactaagcgttttgccctcccccaaagcctgactcatacgggaacagaagctaatggacacaaaagtgccggaaagggtactcaaccccagcggaaagggctgaaaaccaccgggaagcactccttatatgttccgaccgcagcccgcagatttccagcagtcgcacatgcttactcactgtgcttatattcattctggcaactcttccagcagtttgggaacttgaccagcacggataggttgtcctatcctcacaaaaaagcagttagaagtacaccgccagctctccaggtgacagccccagttagaagcacctcgctgggtagcggaagatattcttgacgggggcgcagtttgaccattgatagaattccactgatatcctccttctgtgcttttcttcacctactggatgaatttctcctttatgatgcgatacgctcggtagtggtgatctgataggggcgcatgaccaatacaggttttccgcggcggaaacgcagtagaggatcaaaataatttaagagggtgtgccgagcgaaaaaggcttatgtgaaatccataaggccgtgcctcatatgattttaggcggattagatggaacatacatttccttaaacccataggatacatcgagtgaagttttattaggaaggtgggacaatgtcttcactatggctaaaaagggtgactaatctcttgtgtgtgaaaagtattgtaactatagctttaacgggagtattcgcatatctctctatcataggccagattagcagccaggatttccttacgattttttcagtagtaattgcgttctattttggaacgcagagtcaaaatccaaacgaaaaggttgagaaggaactggaacagaaaaagacatcttcatcagagcagtctcaatcacgataaatttgtcaaaaggagtgaacaataagtgaactatcacggaaacgatttatatagatgttgttgcatgccccaggatcattgcgcaactacccaagggcctatggggcctatggggccacagggagtacctggtcctcaggggccgcaaggtatcaggggagaacggggcccccaaggtcctaaaggagaaaaaggagatactggatgccctggacctattggccccagaggaatggctggaccccaaggtcctcgcggtttacagggagtccgcggcgatattggtccaaaaggagatataggtttaatgggacctcaaggaatccaaggaaatccggggcctatagggccaaaaggggatccaggtccagtagggccgaaaggggatccaggtcctatggggcccgctgggccaaaaggagaccggggagaaaaaggagaacgaggaatccaaggcgaacaggggccgcagggagaacaaggaattcaaggcgaggttggtccccaaggccctcagggggatactggttgtccaggacctcaaggggaacaaggccctgtcggtattcaaggcccgcagggtgagcggggaccagctggccccgccggtgaaaagggtgaaaaaggcgacaaaggggacactggcgaacaaggcccgcagggcgtgccgggaccgcaaggggaaaagggagagactggagctgcccccacggttgttataggttccgtcagctccggaacagaagcggatgtaaaatccaccccgactgcgacgggtatctccttggactttgtggtccccattggtcctcaaggcccgcaaggcgaacagggtccagttggccccgccggcgaaaagggtgaaaaaggcgacaaaggggatactggcgaacaaggcccgcagggcgtgccggggccgcaaggggaaaagggagagactggcctccagggagagaagggagagactggagctacccccacggttgttataggttctgtcagctccggaacagaagcggatgtaaaatccaccccgactgcgacgggtatctccttggactttgtggtccccattggtcctcaaggcccgcaaggcgaacagggtccagctggccccgccggtgaaaagggtgaaaaaggcgacaaaggggatactggcgaacaaggcccgcaaggcgtgccgggaccgcaaggggaaaagggagagactggcctccagggagagaagggagagactggagctacccccacggttgttataggttccgtcagctccggaacagaagcggatgtaaaatctaccccgactgcgacgggtatctccttggactttgtggtccccattggtcctcaaggcccgcaaggcgaacagggtccagctggccccgccggcnnnnnnnngtccccattggtcctcaaggcccgcagggcgaacagggtccagctggccccgccggtgaaaagggtgaaaaaggcgacaaaggggatactggcgaacaaggcccgcaaggcgtgccggggccgcaaggcgcgaaaggcgataccggccctcagggagaaacaggggcagttccaacaatcaccgtggcggaaagcacaaagacaagctataaagtgcgttttactactgacaagcaggatatcctcagtccaaatctgaaatccaacactgaaagttataactataatttgtcaacggttggtacttctgttgacattcctttggaaaacttggcgttgagagttcaaagtaccgcaaccacatccatccgcctttctattttgccaaaacagacgggaacctccgttttggccgatattcgaagagtcagcatctattcgggcggatccattgatgtgcagaccaataacaatgtcacaatctcctctgttttgatattggatgatattgtgtatagccaatctcaagagatgcactggatgcgtctgaggcaacaagacccaaccactaagttgtggtcgatgtgtgaaatccgcacatttgcgtcacaaggcggtgaaagaactaccgtctgtgtggaatggttatatacaggagccacatttatcatcccacagagctaatatccttcccaagtttgataaacgaaattgtcttctatcggagaagtcgttgattgtatcgaagtagaaaataatagaattgtaaccgccttaaaagaggtgttggaatttacgagcaaagcgaagaatttgaaaagattttgcattctatccaaattaaaaagatggccctgttgattgtttcaatggggccatctttgatttaatttcggcatgtccttggtaacgtaactatgaattatctccatcttttttctgattccaggagctgccccccaccatctgccaagatctgaaaaccctacaggggatttatcttctagcaacagtatccaaagatattgcttgcagatccctttaaacacagatttcataaagcctgagagatatggctttttcacatccacgcgatattcaatgcgttgcgacggatgctggattgattttccgcgataaactggatcgcgaaccggaatatactgtcctctacagaatagatcgttttacggggactggtatcttcgaataggtttcaccggcgtattaaacccagcgaaataaaatttttgaagcaggctgaacaaacgctctttcttttcccgatttcccggaaatttccaccaacctggaacttccgcttacaatagcggaaataatggtgttgtaagagattggctcccgccccttttacttgagcaagttggtaattcttcatcgttgggtttagaagcaggttcttgatatttttctactgagaacccgtcctgcgcttacatcaaatattgaggtgttcctccgtcactccataaaccagtgccaatccacattaggaaactgtttgaagcagttccgtacttcctaaaaggttggcacaaggcagtccttaaatcgccgggaacttgaaaccctcttttactgtaccgccagacggagggcgctggaaatcatctgatagcgattccggactatctttggctaaggcatttgctctcgatacattccacccgtcccccatccaaaagctccttgcagcaactttgcggctctaaagcggtgagcttccctagaggaagagttccaatggcgggtttgatgtggttgtcgggatatccttggcaggtcgcatgggagaaaggacgcgcctttaccggcgcgtccttctcaaaccagatctccatccattgacctaccgtgtactgccccgcccagacgatatccattcccttggtttctcaataatcatcgctaacttccctttgacctccgtctgggttttccctagaacattttcgcggatggccttgaccagtctctgggtcgtacccagcagtgcagcgtccctcccagaagctgttcttccgcttacggatgtttcctttcccatttgcctgtttctttgccatgtgtgattcccccttttctttgtttaaagcagagcaaaatttggcgctccagtttgtggttgacattctcttgtgcaggagtatgcccccaaccctgacccatacgggcacgaaagctcatggagcacattggcacaagagcgccggaaaggatggtcaatccaagtggaaagggctgaaaaccaccggaaaacgccccttgtatgccatgatcgcagctcataacctgaaggtcgtaggttcaaatcctgcccccgcaaccaaagaagcggcttgaacaattgttcaagccgcttttctttttaaatcgtcgcacatgaaaaacatccttgatccaatccggatcaaggatgtttttttaccgtctttcattattgtctgtgccttctgaaccgcgtttgcaatgcggcctggatatgtagctgtatcataaccgcagggcggttattttttatatctttatcgcacatcccgcatatccgtattgacaggcttcttgtttttattatatcatatcgaaaggcgccgtcattcgccataaaaagatgcaaaaaattaaataaaattatgtgcattttttaatttcgacgccaagctacgacccaccgccacggagcccgcttagtgtttatttgaaaatagagaaattgccggattgtttacagtctgcggatgagttcaagacaaaaacccaggaatcctttggagtcccaggttttttaacgccgcattcgccgctgtttgccaaaaagacggtatttccgatttttcaaactgcctctgaaacgacaacaagaattggggaatcgctatgcaaaacacagaaaaaacaggggctgtcctgcgaaagctatttttcagcaccttgtacatcagtacatttacctttggcgggggctttgtaatcatcacctttatgaagaaaaaatttgttgacgagctgcattggatcgatgaaaatgaaatgctggatctggctgccctggctcagtcttctcccggcgccattgccgtcaacgcggccatcctggtcggatggcgcatggccggctttgccgggatgctcatcgccattatcggcaccatcctgccgcccatgacgatactctctgtcatatcctttttttatgcggcgtttgccagcaacgtctatgtggcgcttgtgctcaaggggatgcaggccggtgtggccgccgtcattctcgatgttgtctgcgagctgggctttaaagtcctcaaggaacgctctgccgtgcatttgttgattatggccgccgcttttgccgctacattcttttggagcgtcaacgttattttcatcattctggccgccgcattcgccggtatctgcctggagactgcaaagcgcatccgcagaaagggggcggccaaatgatctatcttcagctttttttgagctttcttcaggtgggggcgttcagcatcggaggcggctacgccgctatgccgctgatccaaagccaggtggtcacaagtcatggatggcttaccatgagcgaattcaccgatctgattaccatcgcggaaatgacacccggtcccattgcggtcaattccgctacgtttgtcggcatccgtatcgctggtgtcggcggcgctgttatcgccacactgggctgtatcctcccctcctgcctgattgtctcgctgctggcctttgtctactaccgctacaaacagctttccgcactgcaaagcgttctggccagcctgcgtccggctgtggtagctttgatcgcttccgccgggctgtcaatcctgaatctcgtcgcctttgacggcggatcagcacgccttgacaatgtaaattggctcggtcttggtacctttatcacagcctttttcattctgcgcaggctcaaatggaaccctattttggtcatgattctgtgcggagcggcaggtctttttctgaatctgccggctgggatggtctgaacgcatgggaaatcggtccgtatggctgcgtatatgaaaatgattgcaaaattatctaaaaatcaactcttgaattttgcgaaactgtccaatcacccaaaactcaaaaatacaagttttataaaaccagctcctcaccatacaacttttgtaaaaaatattgataacttgttgaataccaaatttcgccatgctatattgttgatgcggcttcgtggcgaattacacaaaatcaaacaatagcaagttcataatttgtaaaaagaggagactgattatgaaaaagcgtttattgagtctgacccttgcgtccatcatgcttgtcggttccctggctggatgcggcggcggtactgccccagctgcaagcgatgggaacacggctggcggcgcaaacacgcccggcggcaaaactgccacctggaccgtcacctgtccatgggcgccctccggagtggccgccatggtgagccaaaaggctgcggccttgtcaacgacatattcagacaatatcattctggtagccgaagccgttgcgggcgacgcggctaccgtcaacacatggatcactgacacacaggccaatgatccgaagcttgtctttgtgggcgagggcctgctttcaatcacctcgattctggaccccgccaagctccagtttacacaggacgatttcgtatttgttgaaaatttgtactcctccatcttcgttttgtccgccgacgccaagctgaacatcaacagcatggatgatctgaaggcttacgtcgaaagcggcgagcaggtcagcgttgccgttaacggtgcgaccagctcggaagcgttcctggccgcggctttgttcggttccatgggcgccggcgagcatttaaagctggttccgtacacctccgccgccgaagcggcccaggctgtcgccaagggggagacaaattttgccgtgtcccatcagtcgcagatcctcgaaacctacgagcagggcggtgtgagcatcgtctgcgccttcgatgaaaaggccattgaaaacggccccttctccggcgttgagggtgtgggacagtacggttatccatacttccgcaaccgctgcttcattatggcgcgcgccggtaccgacgccgcgacagttgccaatctgaaagatctttacgatcagatactggccgacgacgaggtcaagacctggctccaggacaccatgctgctcgaggtcgatacgatgagcaccgaggacgtcaacgcccatgtggaaaacgtcaaaggcattgtcaacgaatataaggatattgtcgccggttgatcccgctcaaacacagaggatgggatgggtttgctcccaccccatcctttttttacccaatctgttatcagaaggaggctgtaccgcatgaaaaactgggtggatcgcctggacgcccgcctggatgccattggcgccaacctggcaaaaaaagaggttcacatccccacggacctggccggaggaattttattcttcctctttgcgattgttatcctgttggtcacgccgcagcaggtcacaatctcggaaaaggatatcatcaacggacggatgttccccaggctgctgatgatcgtcatgatggtctgctgtgcgctgctgatcggaaaagagctttataaaatagccagaaagctgcccattacatacaaaaccgtcaacctgctggttgaaatcaaagccctggtcattctggcaatcctcgtgctgacctatgtcgtctgccgtgttacgaacctgttcgcggcgggttctgttttctgctgcattggctttttgctctattttcgctgcaaaaaaccgctttactatgcagtcaccgttattttggcagtcgcaatctgggccgcgttccgcttcggcctgaacgtaaatttctaaggggggcgtattatgctgcaatatatcatccctgcgtcggggctgctgttcacgctccagaatatcatttggatcaaccttggcgtgttcatcggcgcggtattcgccgccatcccgggattaagcgttattttgtgcgtcattttgtttttgccgctgacctatcagctcaccgccatcccgggaatgatgttcctgcttggcatctattgcgccggcggctatggaggcagcgtctcggctattctgatcaatacgcccggcacgccgcatgccgcggccaccatgctggacggccatcccctgtccaaccggggacgtacaaaggcggcgctgaagattgctctgtacgcctccaccttcggcggcgtgttctccgcgctgatgctgctgtttttgggtccgcaggtggcaaagatcgcagcgcagctcggcacggcggaatactttatggtgtgcctgtttggtctgaccatcatcgccggcgtatccggaaaaagcatgattcgcgggctgatctccgcctgtctcggacttttgatctcctgcatcggagccgaccccatgaccagctacgaccggttcactttcggcatcccgcgcctttatctcgggttggatctcgccatctgtttaatcggcctgttcgcattggttgagattctcgcaaaggcggaaaaggtgcgggggctgcaccttgacacggaaaaaatgaaggacaacggcctgattaccaaggaggagcgcaggcggatggcccgtcccatcctgatttcctccatcatcggcgtgatcgtgggcattatccccggtaccggcgcctccgaagcctcctggttcagctataacacggcgaaaaacatgtccaagcatcctgaggaattcggcaacggctctgtggaaggcatcgcggccgctgaatcggccaacaacgccgtaaccggcgcgacgctgatccctctgttgacactgggcatccccggtgacggcacggtggccattatgctgtccgcactgatgattaacggcctcaaccccggcctgagcctgttcaccaccgacggcgacatcatgtatgccattatgcttggactgattcttgtaaatctctttatgctcattcagggcaagctgctgacgcagctctttgcaaaggtcgtctccatcccgcaggagatccttacgcccgtcatcgtcattttctgcttcgcgggggcctattccgtgaataaaaactattttgacatcggcgttacgctggtgtttgcggtgatcgcatgggttctgcgcaagctggatcttcccgctgtgcccatcctgctcggcatggtgctcggcaagatgacggaaaccaatttccgtcgggccttgcagatctccgacggcagcccctcgatctttttcagcagcgtctactgcatcattttcctgcttctcatcgtccttgcagtgggtgcgattatccgcggcaagctgaaggaacaaaaagccgtcaaagcggccgcacaaaaggaggcttgacgttatggcctacaatattcttttttatttcaccgatcagcagcgttgggatacctgcggctgcttcggccaaccgttggatatcaccccccgcttggatgaactggccgggcagggcgtcaaatttgacaacgccttttcccctcagccagtatgcgggccctgccgcgctctgtttcagaccggcagatatccgacggaaaccggctgtttccgcaacaatatcatgcttcccaagggcgtcaaaacgctggcggactacatcgagcaggctggttatgagacggcctatatcggaaaatggcatctggccagcgatggtgagcttgaaaagcctccgaccatcgatcacaccgtcaccgcgatcccgcgcgagctgcgcggaggctattccggcttctggcgcgccgccgacgtattggaattcacctctcacggctacgacggctatgtatttgacgaaaacaacaaccgcatcgatttcaagggctaccgccccgactgcatcacagacatggcgctggaattctttgacacgcgcgatccaggcaaaccgttttttatgaccatctcccaaatcgagccgcatcaccaaaacgaccgccggcattatgagggacctgccggctcaaaggaaaaatacaagaatttcatccttccaaaggatctggaggttttggggggcaacgccgcggaggaataccccgattatctggggcaatgcgccagtctcgatgaaaatttggggcggatcgtggcaaggcttaaggaaaaaggactgtacgacaataccgtcatcattttcgcctccgaccacggctcccatttcaagaccaggaacacggacagccacctcaacggctatgatgattacaagcgttcctgccacgacgcctgcctgcatgtgccgcttgttatcgcgggcggtccgttccggggcggtataacgatcaaggagcttgtgagcaccgagagcctgcccaaaaccatcctggccctggccggcgtggaggtgggcgaccggatgatcggggaaaatctgcttgacgtggtggagaaaaaggacgataatagaccaaacgaggtgttcgcccaaatttcagaaagccgtgtgggccggtgcatccgcacgcctgactttttgtattccgtctacgcgccgggcttaaacggcggcgcggcggccagctccgatacatatgccgacgactttctgtacgatatgcgcacggatccctggcagctttgcaacgtggtgtccgatccggcctatgcggatgtgaaggccgatctgcgcagccgcctgctggactggatcgaacgcgcggagggtatgcggcctgtcatcacggattgaggagtgaacggcgtgagcgtttccaataaaaaatcggagtatgtgtatcgctggatcctggcttatattgatgaaaacaggttttccagcaaccaaaagctcccgtcggaaaacgctctgtgccgcaggctggatgtcagccgtgaaacggtccgcgcggcgctcgaccggatggtgcaggaggggttgatttacaaggtacggggcagcgggacgtacttcaacaaggaggtcgccctctcctatgagcttgacgccggcgcggtccattgcaaaaagatcggcctgatccttcaggggcaggacagcagcgccaattccagcctgatccaaggcatccagagcgtgctgcccgccaaccaggtgacgctgcgcacctttctgacggataataaattttcaaatgagcgccggtgcctgcaatcggtcatgtatcaaaacttccaggggtttattatcgacggcgtaaaggccagcattctcaatcccaatctggattgctataaggagctttcccgccggcgcatccccgtggtcttttacaacaattattataagaatctgcgctatccccgtatcattgtcaatgatcttgaatgcgccgaccggcttatcggtctgctgatccgggccggccatacacagatcgccggtatctttgtctatgacaattaccagagcgtcgaaaaatttcaagggatggcggccgccctgctcaaatacggggttgaattccaggatgattatatcaagtggtgcgtctcgaatgaagcgcacgacattcgcttcgtccgtaccattgagaagtttttaaagagcctgcccaggtgtacggccattgtatgctgcaactacattatttaccgtctggtgcggcaggcgctctcagagatgggcaaacaggttccagaggattactctctcgtctgttttgactattccatggaggactgggaacaggagggagtcacctgctccgttcatcagggctatcagatgggcgcgctggttgcaaattgcctgatgcgcatgatcgataaccgcgactgtgacgacaaggggtattcctttgtcatgccgcctaaaatatatgagggagtctctgtcaaacagctgtaatccgctggaaagggccggacgcgtctgcgtccggccctttccgttatccttttatctgtatattatggtgcggcggacagttgccgcgccacacgccgcagccggggcgcggcatagtcaagaaagcatcgaaacgcctcgcaatatctgtttacaggctcaggcccggagaaatcccagtcccgagggcatccgccccggcaaagcggctcgtggacgcacgtcttgcagactggcggcctgcgcgcgccctgcgcctgaaaagcgcggccggccggcgacgccaatgcctgccgcaccgtattctcccaaatactgcccatacgccattcgtcaagcacaaagaaatcgcatggatacagccccccatcgccttccaccaccaaataattgccgcagtgtccggcggatgcgcaggagcccggttccatccccagcatgaggcgcagataatcgtcaaatacgcggatactgacatagacgcccgccgcccaatcgcgataccagcaatcgaacagactgcaaagaaaccggccataatcgcgcggcgtcagggaataatccattgcgcggctgttttccatcggatcaaggcaggggatcaactgaagcggatgctcgccgagcgaccgcagcgcgctgtaaagcttatggggactgcgcgccgcaggtccggtaaccacgcacagcaggtttgtctccaccccgcttttgtccaattgctccagcgcttggacggcgcgtctccacgtcccctttccgtgcgggtccagccgaaaccggtcatgcaaaccgcgtgtgccatcgacagacaaaccgaccaaaaagccatgttcacgaaaaaacgcgcaccattgcccgtccaaacacataccgtttgtctggatggaccagcacagccgcacaccgggcgggcagcggtcctttgcattctgtacaaatgcgcgcaaccaatccaggcccacaagggtcggttcgcctccctgaaacaggtattgcacagtccctccgggctgcacagcctcaaagcctgcgtcaatcaggcggcttgccgtctcctgcgtcataagtcccatgcttttgacctgacgcctgtcggacacatcatcgtaaaagcaatagcggcagcagagatcgcaaaggccggaggccggcttgaccaaaaatgtaaccgcattcatcgtgtgttttttcccctcccctgcgcgcttgcagcgccatccttattttaccgctttctccgcagcgatgcaagccaggaggcaaccgcggccccgcgggtatattttcactgttttgtgctacgctaaaccgatggaacatgatacaattggttcataaaaatcggaggtttgctgtgatgcatgaaaacaggctgattcatgaaaaatccccttatcttcttcagcatgcgcacaatccggtcgattggcgcccatggggcgaacaggcatttgccgccgcccgccgcgccgacctgccggtctttctttccatcggctattccacctgccactggtgccatgtgatggagcgcgaatcctttgaggacgcacaggcggccgatgtcctgaacagcggctttatttcaatcaaggtggaccgcgaggaacgccccgacatcgacgcggtctatatggcggtctgccaggcgatgaccggttcgggcgggtggccgctgaccattttgatgacgccggagcaaaaaccgttttgggcgggtacgtatctgcccaaatacagccgttacgggcagcccggcctgatcgacctgctaaagcgcgtgtcgctgctttggaggacggagcgcgaacagcttttgcaggcgggtgacgagattgcggcgtatatcgcgcagcgcggaccaggcggcgcgcaggcgccgcagcccgcgctgctgcacacggcggccggccaactgcgcgccgcctttgatccggccgacggcggctttggggacgcgccgaaattcccctcgccgcacaacctgctctttctcatgaactacgcccggtgggagaaatccgcagacacgcgttccatggcggaaaggacgctgacgcagatggcgcgcggcggcctgttcgaccaggtgggaggcggtttctcacgctactccaccgaccggcggtggcttgcgccgcattttgaaaaaatgctctatgacaacgccctgctcgcctatgcatatctggacgcgttttctcagaacggccggccgttttgggagacgaccgcgcgccgcacgctcgattatgtcctgcgggagctgacaagccccgaaggcgcgttttactgcggacaggacgccgacagcggcggcgaggagggtgcgtactacctgctcacgccccaatcggttgaacaggcgctcggcgcgcaggacgcggcgcgcttttgccgctggtacggcattaccgaatccggcaactttgagggcagaagcatcgcaaacctgttggaaaacacagcgtatgaacaggagccggagggcttcggcaggctgcgtgaaaggctgcttgacttccgccgcagccgcgcggcgctgcaccgcgacgacaaggtgctgaccgcctggaatgcgctgatgattgctgcgctttccaaggcgtaccgcacgcttggcgacgcgcggtatcttgacgcggcaaggcgcgcggcggcctttttgcacgccagcctcaccggaccggacggacggctgtggctgcgctggcgcgacggcgaagcggccaacatgggacagcttgacgactatgcgttttatgcctgggcgcttttggagctgtatgccgctgatttcgacgctgctcatcttgaagaagcagtttctatgatgcagacgctgcaagcgcatttttgggacggacaggaaggcggttttttcctcacggccgacgacgcggagcgcctgatcacacgtcccaaggaggtctacgacggcgcgatgccctctggaaacgcagcggcgggccttgtcctggaaaggctgtggaagctgacgggcgatcccgtctggcaggcacgcgcggacgggcagctcgcttttctggcctccaaagcgcagccgtatcccgcagggcactgcttttcgctgctcgccatgggcgaggcgctctatccctcccgcgagcttgtctgcgcaacatccggcacagtcccggacgggctgcttgcactcgcggagcgccgccggctgcatacgcttatcaaaacgccgtcgaacgcagcccttttggagcggctcgcgcccttcactgccgcctatcccatcccggaggacggcgcgctgttttatctttgtcaaaacggtgcgtgcgcggcgccggccggcagtgtgcaggcgctcgtccgcctgcttgaacatgcctagaagcaatcagccagccgccggcctgtgggccggcggctggctgatttacgacttgggtacgtcttacaaccccatccgggtaaaaaagcgcatgagattatccatggtgagcgccagatcgttttttgcgcgcgtgcgcgcctgctgataagggaccgccacgcggttgatgctgaaaattgccgatacgcccgcttcatacgcggcgtcaatattgtcgccgatatcgccgacgaccgcgatcagcggaacgcccgcccttttggtgcggcgcgcgacgccgatcaccaccttgccgagcagcgactggaagtcgatctttccctcgccggaaaagaccatatccgcgccgtccaaaagcgcgtcgaagccgaccgtatcgagcaccgtttcgatgcccatctggagctgcgctccgaaataggcgaccatgccgccgcccatgccgccggccgcgcccgcgccgtgcagagaaaggatatcgcgcccaagatcctttttcacaatcccggccatatgcgcaaggcctgcgtcaagcagctcgaccatcgctggatcggcgcctttctgcggaccgaacacatgcgccgcgccaagctccccgcacaagggattgtcgatgtcgcacatggccacaatctccacaccggcaagctcttttggcataccggacaggtcgatggagtcgatgcgcgaaagcgttgccccgaccgggacgaacgcctcgccgccggcatccctgaacactgctcccatcgcggcggccgcgccgcagccgccgtcgttcgtcgcgctgccgcccaggcccatgatgatttttttgcatccgtgttcgagcgcaagccgcatgagctgccccacgccataggtggttgtctgctcggcgctgcgccgctcgcccaccagcggcagccctgccgcggccgccatctcgatcaccgccacgccgcccggcagcacgccgtaaaacgcatcaacatcctcgccccacggtccctgaacgcgcgcgtcaaccttttcgccgcccacagcgcccaaaaatgcgtccacactgccttcgccgccgtccgcaacgggcacgccgcacacctgcgccgccggcacgtgccggcggatggcctgttccataaccgcgcagatttcggaggacgacattgtgcccttaaaggaatcggggatcagaataaatttacgcatgatttttcacaccttatccgttttacggcagcgtcctgccggttttattttgcgaagctcgcgtcggaatactgtttgagcgcgcccacgccgcccatgctgtacccaaacagaacaaacggcatggctgcggacagctcatatttgtcttaaaaggcgccgggcgccttatcggccgcctcgcggcgcggtctttcaatcagaaaatcaaagacaggacaaagatctccgccatggctgcgattccaaggatcagcgtacccatcgtctgcgtcttgtatccctgatccggcgtcatctcgccgaagtttgtgacaacccagaagtacgaatcgttcgcgtgggaaacggtcatcgcgcccgcgccgatcgccataaccgccaaagcggcgctgaccggtgttgtgaagccaagcacgcccatcagcggggcaagaataccggctgtcgtggtgatggccactgtggaggaaccctgcgccgatttgaggatcgcagcgaggataaacgggaagaatacgccgatggtttcgagcgccgccgcgttggcggtgatgtaattgaccatatcggacgaggaaatcaccttgccgagcacgcctccggctgctgtgacaaacaggatcgggccgactgttttgagggtttcattggtgatctcataaaatttattcatcctgcccgcgacggaaagctggatgacgccaaagatcgtgccgaccgccagcgcgatgatcggggtgcccaaaaagccgcagaccgccgccgtcatcccggaccagccggccatggaggagatggaaccgagcgccatgagcaaaatcggaacaatgatcggagccagcgcattaagcccgccggggagcttgccgtattcggcgacgagctgctcatacgtcttgacgacctcgccgttgtcaacgtcgtcgcccgctttaacctttttgccgatgtactttgcaaagaaataaccggcgatcagcggggcgattgaacacagcgcgcccatacccatgacaagcagcagattgtttccgatgccgagcgtattggcggctgcgatcgggccgggcgtcggcgggatgaacacatgcgaaatatatagtcctgcgctgagcgcgaccgtcatggcgacgctcgaggtcatggtgcgcttgacaagcgccttgcggatcgggttgaggataacaaagcccgaatcacagaacaccgggatggatacgacccagcccatcagcagaatcgccagctcggggcgctttttgccgacgagcttaatcaccagatcggccagcttgaacgccgcgccggtcgcctccaggatgctgccgatcagcgcgcccaggatgatcacgataccgatgcttgtaaacgtcccggaaaagcccgcgccgatgacgttggccaatccctgcgacgtgaccgctccgtttgcgtccttgacatccaccagagggatgcccgctacgaggccgaggatgagcgaaatgcccatgatcgacaaaaacggatggattttgaatttggagattgccacaatcatcagtataaccgcaatgatgaatgcgataatcaacggaaagcctgtcataaaaaaacctcctcttttttggcgcaagccatattctctgcgcccgttttatttattctacaccgtttttttattccaggtctatgtctccgcacacataaaaagccgcttatttctggttcacaaacctgtttcgacaatgtatatttcctctttttgtgtcaatcgtccaaaagcagcaggctgccctcgacttccttgaaaaacagcatagccatgtagaaaaccggcgaatcgctcggcagccggacatcgcggcctgtgatgtcgcatagttttttaagcttgtactgaagggtattcttgtgcatatataacgcctgcgccgctgcggagatcgaaccctcggactcgtaatacgcctccagaatccccatccagcggcgcacctcctcgtagccgcagccgcggaacaccttgcggataaactccatttttgtctggcgcgacacctcgtcggcgactagctccagcgtaacctggtcgtatttcattacgccgctgcgcgtcatgcgcgcgctgcgccaagccgtattggcctgcgcgtaagctttatgcacgtcgcccgcctcgccgtcgataccggcgcacagataaacgccaaaggtctgcctggccatcttgcacagccgcagggccaacgcgcgcatctgttcatcggtgcgctgacgcaccagcaaaatctgacgggctgcatttcgcaggataatgttgccgttttcagcttcgacaatcgcggcaaccgcattttccacattttcaatcagcttctggccggccatattgtcggtataatgctccagttcctgcgcactgatcaccatgacgcgccgtgggatggtgatatcgatgccgagagcaaggccgcgttccgcaagcgcctgcccctgcacagggccgccggcaagcacccagttctccagaaaccggctgcgcatgcgcaggtcaaggcgtttgtcgtcctgctccgtgctctccctgattaaaatctcggtcatcttcttgacaacctgcccatatccgatcacctgtccgtactcgccggtaatcccgatgacgccgacaatatcgccgcggtgcgtaatcggcaggttaagcccggtgcgcgctgtggcagtcgcctcctccgcgcggatatatagttccggcagccgttcttcaataatctggcgcgcgccctcgtgtaaaaagccgatgcgcgccggatcggtgcttgcaatgatgtagccctgcgcgtccatcatattgatgttttgccccacgatgccgccgatctcagcgacaatgcgctgggcgctttgagttgaaagctgaaaaccgctcatcgtaccggctcctcaaaagtatcctcatcccagtccgccaatataatgggcataccggcgtaacaagccgtccatccggctgttttcataacaacacatcctttttcccatatgtccatatctgcggagcggacgcgccggctgcacagcagtatgacaaccgctctgcaattattatactaacaacatccgtgcggccgatatgttctttgtactaaaatatatacatatattatattacaaagaatatatcatacaaattatatcttcattttctgtaaaatcgaacagcaccggcaggaaggcggcgcgcatccgccgaattttttgctgaccccaacaattaaaacgatttgactgtcaaacgcacaggccgtacaatgaaatggatgagacggcgctttcgcgaagctgcctgccggcagcgcctttaaaaatcaggaaaagaggtgcccaattgatcgaaaaaatcacagtgatcggcggcggggccaccggccacgccgctgcggcgatctatgctgataagggctttcgcgtcacgctctgcgacggcgaacggttcgccggacgttttaaacagatcgaagccaacggcggtatcctgctgcgcgggaaggtccatgcgattggacggatagaaaccgccacaaccgacatcgaaaaggctgttgcgggcgcgcagctcattgcagtccacgtgatgtcgccgcgccatgaggagatcgcgcgcaaaatcgcgccgtatttgcaggacggccagcatatcctgatcgtccccggcaatctgggagcgttcatattccgccgggtatttgacgagcttcatatgacaaaaaaagtcaccctgaccgaacaggagggcaacctctgtccctgccggctgacgcaggacgctgaggtgacggtcggcctgccgctgcgcccgaaaaagatcgcgtccctgcccgcctgcgatacgccgcgcgtcattgaggcgctcaagggggtttgggactttgtgccggtcaaaaacgtattcgaggcggcgatccatgccgacaacgtcgtgatgcatctggccacgacggtgctttccgccacgcgcatagaggcgatgcgcgacaactttattctgttccaggagggctttacgcccgcgtcgatacgctgcgcgggaaaaatccgggaggaacgcctggctatcatcgaagcgatgggctttacggagcattccaacccgatggacatgttcgaaaccattgtgaatgtcaaagaaaacccacagctcgatgtgttccgtacactgtccgggccggacagcgtcacacaccgctatctgcgggaggacgcctcctgcggcggcgcgtttgcgctgtcggtcgctaggcgcctggggcttgaggcgcctgtattggaagcatttttaaagattgccggcgttctgtgcggcgaagattatatcaaggatggccgcacactggaaaacctcggcttcccgccggagatgacgcttgcagagatctataagcgcatctgatcaacagcgccataaaaaaaggaatgggtcctcccgcccaatgcggggggacccattcctttttttaacaaggctcaaaactcgcgcatcaatttgccgagcttcgggttcttcgcaccgatgcgcgcataacgcagcgaagcccagatactggcctggttgctggtgatgacaggcaggccgaaatcctcctcgataatggggatcatgctgaggatgttcagccccgtgcagctgataaagatggagtcggcgccgtttaagtccatctttttgatctgctgatagacataggtcggttcaatcagcgggacccacagacgctgcttgttcatatcgacgatattggtgacggtcaggccgttggcctccaaaaacgccttttccatcacgttggtggcctcaggatacggcgtgatgacagccggacggctgacgccgagcgtctcaaacgcttcgagcacggcggtgcttgtcgtcaggccgcgcacgccggttttatcctcgatcagcttgatgcactccttgtcgaaggtaaagccgttgatcatgctgccggatgtacagccaaagataatcacgtccggccgcgcgcgcggctcgtcgaatattttgcagccgccctcaagcccctttaccatctcgcgcaggttttccggggtaggcccgatcggttcgaagtagatgtgcatggaacacacgccgacgccttcgggcatgttccgattaaaatcgtcctccgttgtgaccgccatgctcgggcagatgagtccaatgtatccgcgccatgtcatcataggttgatcaatcctttccatccggtggatttcccaaacaaatccaaccgcgctgttttccttattataaaattcataaaaccacctgtctaatcgaaaattctgtagactgtcaacaaaatatcgactagccctgccgctgtcaagaaacatttacaaagtccggccctgaaaattcaacgatttgcataactaaaatctcaaatcagttttacccgtttccatatttttattgttcagggaataatcgggtggattatcgttttttttgttggccgccaacaaattcatgaattggacggttggtcatctgccgaagtatactgaccataggcttttacaaaagaaagcgtctctcatcaattacgcagcaaatttcttgatggaacggagaatggcaatgggatttaatcaccatgaaattaatacaaatcgcacccaggttttatctgaatacataaattcagcgcggtttgaagattttccggcaaacgttgtcgagcgcgccaagcagatcctgatcgagacgatcggcgcggcgctcgcgtccgtcgaaagcgaagcggccaaaaaggcgcttgccctggcggagtgcgcctgcggcggcccggatgggacgtgtgccgtctggggcacaggcaagcgcctgagcatggaaaacgcggcgatggccaacggcacggccgcctgcgccggcggatgggagcaaaaccccttcggtatgcccgcctgcgcggcggtcccgaccgcctgggcggttgcggaggcgaaaaaaagatccggcagggagctgcttacatcgctgattctcgcgtttgaggtttatgaacgcgtggccgcggccgtgcagcccacggcgaaggagcgcgccgaaaaagggtatggccgtgcgagctggcagcttttcgcggcgcttgtgccggcgctgcgtctgacaggtcttgatacgcttcaaatcaacaagggcctgagcatgggcaccgtatgcagcgtgatcccggcgagtcactatgaatcggacggcgccgacacgctcgcgttcgaatacggctttcgctgccagacagccgtgacgctcgcctgctgcgcgctgcgcggcacagaaaaccttgaggacgcgttcgacgacccttcggcttatccgctgcattttaccggcgaggaacacggggaacaatatacgcaggatgttggcaaggtttaccgcatcctggaagccgtccccgaaaaaagcgccggcgaaacagccaacgacttccaaaagcgcgcctcctccgtcttttccgtggagaggatcggacagatattaactgcgctgttcgagatcgaatactgcgaggacctctcgtccattggaaagctgctgacactgtgaaatcgcgccgccaaacaaattgatagaccggaggaaacagagatgctcgaaaacaaccgaacctgcacgacgcagtatacaaagatactcagcgattttacggcgaaccttcgctatgaggatatccccccggaggtattggaacgggccaaaatggtcatgctgcaaaccgtgggcgtagcgctcgcggccaaagcgtcccctgaggcccgcaagatcattgaaactgcccgcgatgcaaacggcggcgtcggcggtacggcgaccggatggggtacaggcgaccgcctttcccccgcgtgcgccgcgctccagaacggcacgctcgccgatctgctcgactgggaggacaccgcctggaccggacacccctcggccggcatcgtgccggtcgcctgggtcatggccgaatcgcttaaaaaaggcggcagggagctgctcacggcgatcgtcgccgcatatgaggtttaccagcgcatcgcgatggtggtccagccctcgctgacgcggcagcgcaccaagggttgggggcttacaagctggcagctgttcggctgcattgtcccagccgtgaagctcaaaggctttacaagtgagcaggtcaatcaggcgctcggacttggcgctgcgtgcagcacgctgccgacgagtttccatgaattctgcatgtccgatttctatcactatgagcacggcctgcgcgcccgggaaggcgtcatgatcgccgaactggtggaaaagggcgtcaaaggctgcctcaacgcgcttgacaacccggccgattacgaagcgcacatcacggacgaaccgcgccccgagtggtatacaaaggagctcggcgagcgttggctgatcatgacgacgctgctcaagcactggcccgcgaacatgtgggtgcagacgccggtggaaattgcgtatgacctagttacggagcacggcatcaagcccggggacatccgcgacatcattgttgacccgcccaaggagggccgcatggacacgccgcccgacgaaggcttccgctcgctcacgcacgcgcagttcagcacgccgtacgtcatctccgcgctgattcatgaccgccatcccggcgcgcattggtattcccccgcgatgctccagaacccgggcgtcatctccctggcgcagcgcgtgctgcctggggattccgatcgcgacgcgatgggcgttggctttaagatgttccagcagggttcgttcccgcgcaagacggtcacgatcaatctcaaggacggccgcagctactccgcgtcgctcgactgccagctcggccacccggccaatatgatgagccgcgagcagttcgccggccggttccgtatccaggcatcccccgtgctcgacggcgaacgcatggagcgcgcgcttgacgccctgctccacatcgaggactgcgacgacatttccaggctgcgtgaatttctttattgagccaccggcaaagggggtgaacatgtgtccagctacgcgatcatcggcttcggctgcgcgggctatcaggccgcgcgcgccatccgggggcgggacgaaagcggcgcaatcgacgtcttttccgacgtcgggcttgcgccgtccaacccgatgctgaccacctattatacaaagggcgcgctcgattacacaggcatgttccccttcgggacgctgccgcaaatcacggaacagctttccatccgctttcatgggggccagcccgtgacgggcctcgacgccaaaaggcgcacgcttgtcgcgggcggccgggaaaccggcccttatgacaagatcctgatttccaccggcgcgtcggcgttcgtgccgccgatcccggggcatgacctgcccggcgtcatgcccatgcgcacggccgccgacgccgaacggctcaaacggacgctctctgaacggccaatccgcacggcgcttgtggtgggcgcttcgatgacgggcatcaagcttgtggagctgctgtgcgccgccggcgtcaagacggcggtggccgacggcgcgggctggatgttcccgcttgcagcctttcagtcgacggcgcagcgcatccaggcgcgactggagcaaaagggcgtgccgcttgcgtttaacgcgctgctttcagaaatccgggagcaggacggccggctgtgcggcgtgatgaaggacgggcgcagctttgcggcggacatcgttctggtctgtatcggcacgcgcacaaatctgacgtttttgaaagacagcggcattgagatcaaccgcggcgtgcttgtcgaccatgccatgcgtacaaacatgccgggtatttacgcggcgggcgactgctgcgaaagcttcgagcttcagtccggcgcgcagcgcgtcgtgggcctgtggatgaacgcggggcttcaggggcgcgccgccggcgaaaatatggccggcgggcaggcgatatttgattttaacatagtacaaaacatcagtcattttatggacgtcgatttcataagcatgggcgacgtccacctgtgcggcgagcaggacgactattatgaaaacagcggcggcccatactatattaaggccgcgcgggacggctcgggcgtcaagtgcatcaacctgctcggccgcgcggacagcagcggggcgctgaaaaacggctttatcaaatccctgctgcgcagcggacccatctgggaccgcgccgcgatctgccgcctgcttgcgggcggcatcccggaatcgttcattgcgtttatgaggagggcgggaaatgacggagcttgaaagactgctcaaggcgaaaatccccggcgaaaggaccggcattgaaatcaggcattccctgtgtgcgatttgcagtccgggccaccactgcgggcttgactgctatgtgaaggacggcgttattttaaaggtggagggcacgccggaccatccctataaccgcgggaaaatctgttcgaagggcgtcaacaacaggcagtacgtttaccgcgccgaccgcatccgcacgccgctgcgccgcgttggagagcgcggcgagggcaaattcgagccggtcagttgggaagaagcatataaaatcatcggcgaaaagctcaatgcggtcaaggcgcagtatgggccgcaggcggtcgcgtttttcagcggctactgcaaatggtaccgcccgctgtttcacaggttcgcctattcgttcggctcgatcaactacggcaccgacgacagcacctgcaaccaggcgagcgtcgtcgccggcatggtcacaagcggcgcgcccgccggtcccgacaccggccgcgccaacaccttccttggatgggcgttcagcggctactattcgagccatctttccatagcgggcgtgcgcgccctcaaggagcgcggaggcaaggtcatcatcgtcgacccgcgcatcacgcccgccgtcaaaaacctggcggacatccatttgcagatcaaccccggcaccgacggcgcgctcgcgctcggtatggctaagatcatcattgaaaacggctgggccgacatggacttcatcaaaaaatatacgcatggctacgagcagtacgcgcagtatgtcaagcagttcggccttgaaaaagtcgcttccatctgcggtcttgacccggccggtattatggaggccacgcgcatcttcgcgacgaacggcccggcggcgatcaaccagtccgcctcgacaatggtccatttcatcaacggcttccaggcgttccgcgcaatcctgtgcctgtccgccctgaccggtaacttcgaccagccgggcggcaactttccaaatccgccgacctatctgcataagccggccggctttacgacgcgcgagcacgaattttacacctgcaaaaagcccgaggggcagcggcggatcgccgagggcaagttcccggtgtgggatctgatgtgcgacgagttccaggcgatggacctgtcgcggcagatcatcgagggcacgccgtatccggtaaaggcgatcttcgggcttggcatgaacgtcaagatgttcccggcgacggataagctgatcgaagcgatcaaacagctcgacttctttgccgacgccgacctgttcatgagccagaccgccaaatacgccgatatcgttttgccgtcgtgctcctctctcgagcgcagcgaattcaaagtctaccagggcggctatgctgtgctgacaaagccggtgatcgagccgctgtacgaatcaaaatccgatacagatattctctgcgagctggcgcgctcgatgaagcttggggacgggatgcttgaaaaagggtatgaggcatgtatcgactggatcatcgacggctgcggcctgacggtcgccgacttaaaaaaacacgacatgccggttcccgtgcccgccgcaaagccggtgcagcccggacagtacctggccaatggctgcaagacgccaaccgggaaatttgaattctactcggaaaccctggcgcgtttttccggggaatacgggcttgaaccgctgccggtctactccgacccgctggccgatgaaaacagcgacgatatgcgccgcggctacccgtttttgctctcgacgggcgtgcgcgtgccgaacacgattcactcgcgcctgcacgaagtcccctgggcgcgcagcctgcgccccgacccgtgctgcgaaatcaaccgcgaggacgccgccgcgctcggcatcgcggagggggacgatgtggctctttacaactgccacggcgaaatccgtgtaaaagccaggcttacccgcaagatcaagcgcgggcagattttcatggtccacggctacaccgaggcgaacgtcaatctgctcatcggggaaaagcatctcgatccgtattccggctatccgggcttcaagggcgcccgctgcaatatcagaaagctttcgggggtgggggaatgaaatcggtcattgtgttcgatccggacaaatgctgcgcgtgcgcggcgtgcgcggtcgcctgcatggatcaaaacgacatcgatgtgcaggcacgcgaggaaagctaccgcaggacctttgacctggagcttgacgaagacggcgggctttactgcgcttacctctcgtccgcctgcaaccactgcgcggatgcgccgtgtatcgcggcgtgtccggtcgggtgcattaaaaaggacccaaaaacagggatgaccatttatgacaatcacaattgtatcggctgcaaaagctgcgcgatggcctgtccgttcggcgcgccgcgctaccggccctccgatgggaaaatggtcaaatgcgacggatgctatctgcggattcaaaacggcctgaagccggcgtgcgtgcgggcatgctccttcggcgcgcttgaatgcatgacagagcggcagttcagtgaaaaaagcggcgaaaaagcggccggcgcgctggttcggactctgcggatcgtggaataagcgcgctgggccgggtcccagatcaccggcctgtattcacagcgcggcgcgccgcccaaattggcaggccgcgccataccgttaagaatgcggctgacagaaaggcaaactgagaacgaacgaggaggaaaacaggtatggcagaaatgaccaactttgtgcatcccgcacagcaggaatacaaaccgtttaagccgggctattttatcaattcgatcatcggcctggcgctgatctttggctttggcttcctgccggctattgagccgctcaccccccttggcatgaagctgctcggcatctttttaggcatggtctatctttttacagtctgcgacgtcacctggccgtccattgccgcaatcatcgcactcggcctgagcgggtactgcaccatcaatgaagcgatcgcggccagcatggggcacccggtcgtattccagagcatcatggcctatctggtcacgggcgcgatgcaatattacggcgtggcggagttcgtcgcgcgctggatcatctcccgcaagtgtttccgcgggcggcctatggtgttcacctatgcttatttcctggcgtttacctttgtgtgcatcatcatcaactccgtcgcgatgatcttccttggctggaccattctgtacggcgtctaccgtatgaccggatataagcggggggataagtacgtcaccctgagcctgatcggcctggttctcagctttatgatgggcggcgcggtcgtcccgttccgaagctggcagtacagcctggttatgcagtatggcgaagctgcgggcattgagatcaatttcgccgtctttatggcggtcggcgcgatcatcaccttcggcaccatcacgctttacacgctggccatgaaatatgtctttaagaccgatttctccaaattgcgcgactttgacccacagtcgctcaaaagcgaatacgcgcatatgaacaagcggcaaacgatcgtcctggtcgtcaacgcagtcgtcatcggcgtcatcctgctcgcctccattgtgccgtcgtcctcgttcatctatgaatttttcaacaacaccctgtccacggccggtatttacggcatcggcgccattgcgctgtgcctgatcccgctcaacaaaaagcgccagccgctgattgaattctttgatgtcgccgccttcagcatgcgctgggaggtcatcctcatggtcggcgcaaccatggcggtggcaagcgcggtgatctccgagcagagcggcctgctggcctttgccagcaccgcccttggtcccctgtttgtaggcaaaggccccatcggcgtcctgctgattgtcatcctgctgtccgcgctgttgaccaacatcggcagcaatatcggtttcggcgcgctgctgatcccgatggtcacgccttttttggcgccgaccggagccaatcccgtcgtcgttggtatcgcgctgatctacgttgtcaacatggggctaattctccccggcgcttctgctcccgcagcgatcatccattccaacaccgaatggatggattccaaggagatctacaaggttctgtgcttctccatggccctgacgctgctcgtcgccatcccgaccctggttgtggcaaacgcaatcgtctgaaacccatcttaaaccctttttattttgcagggacagcctttatccaaggctgtccctgcattttcgataaaattcgactttttaagcacatttccagaatggatttatcctgtaaaatcgaacgccgtttatgttacaatatgcgcaagggaaatgactttgccgttcgcggccgccattcggcggcggccgctgctttgcagcggattgcgtatgccgcaccacagacaaaaccggccttgccggttttaccgacgctttgcggcacacaagtccaaatgggcttgtcgctgtgctgcaacaggcatatacaggaggcgtaccataaaagcatcaagacttatcgggggaagaattgctgtgaaaggggaagcattgcggtgaaaattgaacatctgatctacatcacagagattgcaaagcgcagatccatatcgttggcggccaaacagctttatatcgggcagaccacgctcagcgccatcgtcaagtcgattgaggatgagcttgatatacaaatttttcagcgcacatacagcggcgtgatcgccacgcaggagggcgaaaagatgctcgggctggccaaaaagatcattgacttgtatggtgaaatgacagagattgaacgcgaggcgagtgtgcgggagcaaacggtccatattctggcgtccacctcggccaacagcaatctgagcgtctttcttacacagcagatgcagatacgcagccctcagtcggctctgatctttcatgaaccgatgcgcaccaaaatgctggccagcatgtttgaagggatcgccaatctggcagtcggccactgggaaagcagtgaattgaagcaggcggaacagatcgctcgtacaaacggcatcacgatggagcttttatattcggacagcttttatctgtgcgtaagcgcccattccaaatatgcggaccgcgagagcgtcgacatcgcagagcttgctgacgaacgtcaggtgacgccgcactattattttacaaattcggtcaactctgtttttgcccaagcgttccgcagcgtccctcgggtcgcgtccttcacaagcaacgagcttgtcaagctctccgtgctcaacagcaacctgatcgcttttttagccggcatcaactttatccgcgatgagaacgcagcatcaggcgcgctgcgcgtgatcccgctgacagggcttgccgaaaagaacgaagtgggcgtctatgcgctttaccgcgaaagcgagctgaccgagccggaacagtgcgcgctggagatcgcgcgggagttttttcgcgcgggtatcccgcgccgcccggcagggttgccgcccgcactctgaaaaacggcgtgaaccgcgccgggcgacagggaaaggctgcgccgcggatgaaggcgcgcgcaatcgcgcagccatccgcgcagggcattcctgcggcatggcgcggccggcaggcgccgggcaaaaggcgcccattttacagccacgtctgattttcacgccgcacctgtgtcaggccgcccagctttgcctgcacagccatcagtcccgcaggcggcagcgcacgcgcctggcgcgggcagactgcaacgcagcgcatacagagaatacacgcctcccccgtcttatccggcgcgtccggcgggatggcgcccaccggacagcgccgcgcgcaaagcccgcagctcacgcatctgtccgaagcctgtggccgcagcgggagcggtttgcccgcgcagtacggccggctgcccggaacagataccgccgcatgcctgcagctgtccaatttttcctgcaccgccgccgcgaaagcttcaatctcctgcatgtcgcgcgcatccggccggccggccgcgactgtgcgcagcatggagtgctccgcaataaaagcgccggccgccacaggtacaaacgcctgcgctgtgagcaggtcgcacagctcaagcagagcgtcttcaaacgcgcggttgccgtatacggcaaccgccacggcaggcgcgcccgcgcccgcgatgcggcgcaccgcttcgcgcgcgggcgcggggacgcgtcccgcgaacaccggcacagcaaatacagcgggcagttcgccgtccgcctttggtatgaaaacgtcttggtccgacaggtcgaaaaactccggcgctttggccagcgcgctgcccagtgcgcgcgccacgcgccggacgccgccggtcgggctgaaataaaacacgcgaaccgtttgatgcattgccattcctccccgcgccgcaggctttgggaaaacgcgcggcgcgctgtttttttcagctattgtatcacagccgggacagcgagacaatccatacaaacatcggttgcataaaagtgtataaatgattgatttttcccgaaaatatgctacaatatgcacagggcaaccggcgaaaccagctccgctggtttcgctgctgttttgcgtatccaaacccgaaagggcttgcgctgcggcaaaataaatttgtatatatcggacaggggtgatcggatgtcgtatctggaacaattggaaaaggttctcgatcatatcaccagcatcggcatctatgttatccggcgcgatacgcatgaaatgctttatttcaacgaccgtgtccgggcggtcgcgcccgctgtgcgcattggatccgtctgccacgagctgtggcccgacacatgttccaactgcccgctgctttccatcggcgaccgggagtcgcatacaacggtatcgtataacgatccattcggtggaatggtcgatatcacggccaccagaatgctctgggccgaggggataccggcctatatcataacggtcggcccgcacacgctcacaaggcgcgagcaggagctggagtggggccggcggcggatgctgcaggcgatttcgtatgtttattcaatggtcatctatgtcaacctgaccagaaaccgttttttcatggttgaatacgaacggttcgatacaaagcaggcgcccgatgagggcaactttgacgaactgattgaaatcggtgcgcaaaccatgcatcccgatttccgcgaacagtttaaaaacacctttggccgcaagcagttgcttgagcggtttgcaaatggtgaaaccaatatttatatggagcatcgccagctaggcgacgatggggaataccactggaccatgacacgggtcgtccgcgtggaaaaccctatgagcagcgacgttcttgagatcacactctcgcgcaacatcgatcacgaaaagcagcttgaggaaaggctcaaggtccagcaggagatggaacgcgagcgaatccgctatcagacggctgtcgaaagtacggacgacatcatgtttgaatatgatgtctcatccgattttttcacagcttttgagggcgtctttcaggatggcgtgcgctgtacgcaacgatttgaacagccggggtatcttagccggatggaacttacaggctttatacatccggactatatcgaacgtatgcgtgacaagctcaacggccgtacactcgaggatattgaaatccgtatgcttacaccgtatacacaggaataccactggtttctcatccggggcaatatgctctacgaaaacaaccgccccgtgcttatgatcggtatgttgcgcgacatcacccatattaagcagcttgagctggaacgggagtcgctcgaacgcatctgtaattttacggtcaatcaggattacaaccttgtcgccaccattgaagtgccgacagagacgtatgtcatccgcttctgttcgcttggctccatctatcagctcccgcaggccggcgcatatcccgatcaggttgcgcgcattgcgcagctcgcggtatatccggacgaccgcggtgaatttataagacagctcgatctgcccacgctgatctcccatctgaagcagtccgatcaggagtgccgcctttactgccgtatcctgagcaacgacggcgccttccgctggaagcgcatccgttttacatattatgagggcgaccagacgcatatcctgctaaccatacaggacgttcaggaggtgcgtgaggccaagaaccgtgagctggtgcgcaaccggatttttgcaaccgccttccgtgacctgtatgaccaggtgttcgaagcggatctcattacaaatgaaatccatgaaatcatctgtgatgaggatggaatccagcgcatcccgggtgggcagacgctgcgagaggtaattgactaccgctgggagcacctgatccatccggattttcgccgccagtatatgcaggaaatggatatggacacgatccctgagcggctggccagctccccgagcatttattttgaggtccggcgcaagacctcttttacaagtgacgagtaccactggtattcgatacagattcaatttttatcaaaatcttatgacagttataaaatcatgctgtacatgcgcgacatcgatcaaacgcgccgtgaggacgaacgcaataaacgtgccttgcaggacgcgcttgtgctggcgcgcgacgccaatcgggcaaagtccgattttatttcgcgtatgtcccacgatatccgcacgccgatgaatgcgattatcggcatgactgccatcgcggccgccaatctcggcaacgaggccaaaatctctgattgcctgcaaaagatcggcgtatcggccaaatttcttctgtcgctgatcaacgatattcttgatatgtccaagatcgaaagcggcaaggttgtcattgcgcagtgcgaattcaattttcaccgcatgatccagggtatttcatccgtattcgggcagcaggccgcgcaaaagcgtcttgcattcaacgtctatcttgaagaaaattttccattgacctgtacgggcgacgagctgcgcatcaatcagatcctgatgaacctgctcggcaacgcaatcaaattcacaccggagggcgggcgcgtatccctgcgcattgaacgcaaaaaggtcaaggaacacattacgcttgtctgttttgaggtcgcggataccggcgtgggcatcagcccggaattccaaaagcgcatcttcgatccattcgagcaggaatcctccggcagcgggcgcgtccttgaggggactgggcttgggatgacaatcacccagaatctcgtgtcgctgatgggcgggcgcatctcgctggaaagcgaggttggaaaggggtcgcggttcaccgtggagctgccgttggaactgggagaagcatccgagccggcggcgtcggacagtacatgctttggccgcctgcgcgtgctcatcgtcgacgacgatgtcgtcacctgcgagcatacacagaccatcctgtcgcatatggggcttgagtctgtctgggttacgtccggcgagcaggccctgcgggagctgcgcgaggcgcgccgcaaaaatcagcattatgacgttgcgttcatcgactggaagatgccggatatggacgggcttgaaaccgtgcgccggatacgcgagcttgccggtcctgaaacgctcgttatcattatgtccgcctacgactgggcacagattgaatccgaggcgcgtgccgccggcgtggaccatttcatttccaaaccgatgttccccgagagcgtgcgcgacgctctcagccgggccgtgcaggacgcaccgcccgcacaggagccggattcctaccaattttgcggggaacggatattgctagtggaggacaacgagatcaatatggaaattgcgcgcacgctgctggaaatgcaggggttgaccgttgacgaagccagcaacggccaggaagctgtcgatcgatttcaggcgtcggcacctggctattaccgcgttattttgatggatatccgtatgccggtcatggacggtgtcaccgccacgcaaaaaatccgcgcgcttccgcgcgccgacgccgcaaccgtccccatcgtggcgatgacagccaacgcctttcaggaggacgaggagtatgctggtcagatcgggatgaacggttatttaattaaaccaattgacataaaatccctgtttaaggggttgaaccagcttttaaaccaggggttgacacaaatctatatttgagagggtggattatatggagtttggacaactgctcagggacattggggtggatgaaaaagcaacgctggaacgctttggcggcatgagcgagctgctgaaaaaatttattctgaaattcccagaggaccccacatatggacgccttgtgaatgtgattgagaacggcgtgcttgaggatgtggaacgggaggtacacacgctcaaagggctgacggccaacctcggcatctctggattgaatcaaatttgcagcgagtgcctcgattatctgcggcagcgcaaaaccacgctgcttccggaattatatctgcgcattcaggaggaatatgaccgggtcgttgaattgatcagtgaatatcattcataaacaaggaattatattcataaggtgagtatgtcaaccatacgggcgcttttttgcggggaagcgcccgtatgtgtaaaaataatcgccctgcgattattttttcctctatggtcgggacgatgctcgggcgcgtcccgctgccgccctgacggccaattttatcatgccgcgctgtggatatgacaaaatagccgcggccccggtgcaactccatttgaccgcgccgtctttcaggcgcatgaatgcaggcttctaaatattaaacgagtttatatcgcgtatgtgggggagaaatggtcatgaaaaaaataatgataatcgatgatgacacaaccagcctcgcgatcgccaaggcgctgcttgaatcagaatatgaggttgtcaccatgcagtcgggcctgcaggcccttggatatctccaggatcaccagccgcctgaattgattctgctcgacatggtcatgccaggcacaagcgggatggacgtactcaaggcgcttaaagaaatccccaagctggcggatatccctgtcatctttctttcaagcatggaggggatggattttgaagtcgagggctttacgcatggcgccgaggattttattcaaaagccaatccacgcgcagcttttgaaaatgaaaatcaggcgtcagctgtacatccatcagctcaaggaggaaaaccagcttctgcaacgcaagcttcagttgctcaagatcaagattgatgcggtgtttgataatctgatgtaatcccggcagggcgcgtccacatgtatgggcgcgcccttttccatattttacggatgggccggccgtacaggtggctgcccctgcatatttcctatgtaccccgttttcacgcccgtatccaaacggacgcttgacatgaaacccccgcgtccgctataatatcttaaagggcaagcggtgcggccgcttgcagcgcgccgttgcaatgcagcgggctggaaatgcgtaagtccaaattcgcgggacttacgcgttttgcttttctgaattaaaaaatggcggctgtctgcgcaacagctttcgagatgaacttgatttggaaaagcagcagccgtcagcgccatggatgcctgcggcgcatccatatactactcaaagaagggggaaatccatgtatcggcaacttataaaaagtatccgcgaattcaagcggccttccatcctttcgccagtctttgtttcgctggaggtggtgatggaatgcgtcatcccgttcgtcatcgcgcagcttgtcaaccagatcaaggcgggatgcggcatgggcgtaatcgccggcttcggagccgctctgatcgccatggccggcctgtcgctgctgttcggcgtgctggcgggcaatgcgtgcgccaaggcgtcctgcggctttgcgcgcaatctgcgcaaggatatgttttaccagatacaatcctattcctttgaaaacatcgaccgcttttcatcctcgtcgctcgtcacgcggctgaccacggatatcaccaacgtccagatggcctatatgatgattatccgtatcgccgtgcgcagccctctgatgctcctgttttcattcatcatggcttttatcatgggcgggcgcatggcgctcattttcctgattgtagcgcccctgctcggaatcggcctgttcaccatcattcgtatggtcatgccgcttttccgcagggtctttaaaaaatacgacgcgctcaacaactccgtacaggaaaatattcagggcatgcgcgtcgtcaaatcctatgtgcgcgaggattatgaaaagcagaagttttccgcagccgccggcgacgtctgcgccgactttacgcgcgccgagcgcatcctggcgttcaacaatccgctcatgcagttttgcctgtatacggtgatgatcttcgtgctgtcgttcggttcctatacgatcatcacaacgcgcggcctggcgctcgatgtggggcaattttccgctctgctgacatacagtttccagattttaagcagcctgatgatgctttccatggtatttgtcatgattaccctggccaccgaatcggcgcagcgtatcgccgaggtgcttggggaaacaagctccctcacctcgcccccgcaggctgtgacagaggtgcgcgacggttcggtcgactttgacggcgtcagcttcaagtatgccaagacggccaagcggatggcgctttcaaacatcgacctgcacatccgttccggtgaaaccatcggcatcatcggcggaaccggttcctcaaaatcgacgctgatccagctcatatcgcgcctttatgacgtgacggaaggctgtgtgcgcgtcggcggcgttgacgtgcgccaatatgatctggaggcgctgcgcaatcaggtgaccgtcgtgctgcaaaagaacgtgcttttttccggcacgatcagcgaaaacctgcgctggggcaacccggacgccaccgacgagcagctaaaggaggcgtgccggctcgcacaggcggatgaatttatttcgcagtttccaaagggctacgacacctatatcgagcagggcggctccaacgtctccggcgggcagaagcagcggttatgtatcgcgcgtgcgctgctgaagcgtcctaagatcctgatcctggacgattcgaccagtgcggtcgatacgcgcaccgacgcgttgatccgcaaggcgatgcgggagtatatccccgaaaccaccaagatcatcatcgcgcagcgcacctcatccgtggaggatgcggaccgcatcgtcgtcctggacggcggcacgatcaacgccatcggcacgcatcaggagcttctcgcggctaacccgatctatcaggaggtctatacatcacagaacaaggcaggtgatcaggatgaatataactaaaggcgcgccggtcccggtaaaaaatacgcttgcgcggctgttttccacgctgtttcgcttctatccggtcatgatgccgctgacgcttgtctgcatcctgttcagcgccgtggtcagctccattccggcggttttcatgcagaatgtcatcgcggccgttgaggcgagctggcaaagcggcgattggggcgcggccgcagggcggattctgccgcttgtcggcatcctttgtgtgttttatgtgctgtcgcttgccgcagccatgacgtttacacagcttatggctgttatcacgcagggctttctgcgcaagctgcgcgaaaacatgttcagccggatgcaggatcttcccatccgctattttgacacgaacaaccacggcgatgtgatgagctattacacaaacgatatcgacacgctgcgccagatgatttcacagagcttcccgcagcttgtcagcgcgggcgttgtcgtaatcaccatctttgccatcatgatctattacagcgtctggctggcgctggtcgtcatcgccggcgtcgtctgcatggcgcttgtcacaaagcatgttggcggcggctccgcccgttacttcatccgtcagcagcatgcgctcggcaaggtggagggctttgttgaagaaatgatgacaggtcagaaggtcgtcaaggtattctgccatgaggagcaaagcaaggccgatttcgaccgtctcaatgacgagctgttttcggacgctgaacttgccaaccgctacgcaaataccctcggcccgatcctcaataatatcggcaatatcctctatgtggttgtcgcgctgaccggcggcgtgctgcttttgtccggcgcgcccaatttgagtatttgcggccttggattcagcatcagcatcgttgtgccgtttttgagcatgacgcgccagttttcgggtaacatcaatcaggtttcccagcagctcaacgcggtcattatggggcttgcgggcgcgcagcgcatttttgcgctgcttgacgagcagccggaatcggacgagggggttgtgacgctcgtcaatgtccgggaggatgaaaacggcgcgctagtcgaaagcgccgagcgcaccggactttgggcctggaaaaagccggacggcggcggcgcggcctatacgcggctggccggcgacgtgcgcctgaaggatgtggattttgggtatgtgccgggaaaaaccgtcctgcacgacatcaccctctatgccgagcctgggcagaaggtggcgtttgtcggggccacgggcgccggcaaaacaacgatcaccaacctgatcaaccgtttttatgatatttccgacggcgttatcctctatgacggcatcgatatcgggcagattaaaaaatccgaccttcgccgcagcctcggcgttgtccttcaggatacaaacctgtttacaggcaccgttatggacaatatccgctacggccgccttgacgccgtcgatgaggaatgcattgctgcggcaaagcttgcgggggcgcatgattttattacgcgcctgcctaatggatacgatacgccgctttccggaaacgggtccaacctttcacaggggcagcgccagcttctggccattgcgcgggctgctgtcgccgatccgccggtcatgattctggacgaagccacctcgtccatcgatacgcgtactgaggccattgtccagcgcggcatggacgccctgatgtatggacgcaccgtgtttgtcatcgcgcaccgcctgtccacagtcaaaaacgcggatgtgatcatggtgctcgatcacgggcgcatcattgagcgcggcagccacgaccagctcatcgccgcgcgcggccagtattaccagctttatacaggcgcattcgagctggagtgacgcgctgttttgccaggcagtctgcacagccggtcgggcttcgtacccggccggctgtttttttctttaagatactgcaaaatcactaaaaagctgtcgttctgtgatgtcataaattacaaattttatttattgtgatgaacaggtgattattctattgcaaatctatcaacaaacctttataatacaaatagatggaaataaatcaaaataattccatctgagaaaggaggagaattaataggtaagtttgtttatttaaattatcagcagtaaaaatgccgcacatggaaggagaatggaaaatgaaaaaatttggaatttttttgaccatccttatgttgactgtcacaacttgtttgccgataagcgccaaggataccgaagctcctgtccgaagcccactcacagacagcagcggagttttggaatcccgcacggttgaccagtataccgatgaaaatgggtttctgattacggaggaaacagaggtctatacatatcccgctttgacacgtgcggcagaaaagaaaaaaaccgcggtaaaaaattataccatttccgctcaaggtgtcggagatattctgacgattaaattggacgcggatttctattatataaataatcagaaaaattccgtgcgttgccccagatattattcgtcttatactgtccacaacaaatcgtatgtcgtcagctatgaggaaaccgatatggagcagacaagcaccgccacctccgcaaaaataaaaacttactatctggttaaatacaaagaaggcgcatctggtactatcggagggacaatgactaaaaagccgagcatatgggtttcatgcagctatcttggaaaagtcagcactggcgcaagcggctgaggaagggggtaatcggctgtggtgctttttttggcgtcggtcgctctggccgcgtgggtgacacgggctaactataatatcatgcgggtcgatctcgttttcctggctttcctgacgctcgctcccctgctgcaccgcgtgcgtttttcagccgggcttgagcgcggcgatgggcacgtcaatgtccgcgtccggttcggctttgtgcccgcggagcgggagctgtttacgaaaacggttgttctcagcatggcgctgaacgtttttctgctgctcgcctgggagacggccatgcagctttccccctcgctttctgtccactatgcgttgcaatgcctgttgtttttgattccgctccttcatctgctgctgtttcgcggccgggctttcctctttgctgatatctgctttggcggggtgatggcggcgctctgcgcggcggaggatttcttccgttcgctcgacacttcgattgaattctttctgtatctgctgcggagcgacgctgtcaaatggcttgcaatcacgctggcctatggcgcgttgtggggtgtatacagggcggtcaaaggaaaactgataaaaacccggttgccgcagaaggggtaaccgccgggcgaatatcccgtcatgaaaggccgggcgggtcctcgtgcgaggacccgcccggccttgttgtttatgcgctttccttaaaacaggctcatctgtttggccggctcctccggacgcgtccatacggccgaccgctccaggcggtcctttggaatatcgccgaggaaaacagacggcgcgcccgaggtcaaaagcaaaagctcctcctgcgcccgcgtcatgccaacgtaaaagagcctgcgctcctcccccggatcgctctgcccgcgcatcccggtatgcgggatgatcccttcattgacgccgcagaggaacacaacggggaattcaagccccttggaaccatgcagcgtcatgagcgtgaccgcgtcgctgtggtacgttctggttccgctgcggcgcaggtcgccctcctgtcccagcgcgatgctggcgagcagctccggcatacttttggcgcaggcggccaagccgcgcagccgccggaaggcggcgtcatcctcaagtcccatttggccaatccacagatcgaccagccttacgggcttttccttttgaaccgccagctccgcaaacgccatccgcagtgcctccatgcgctctttccccaagccggccgacgccagatgcgcggacaggcggtcgctgccgctttgcaggctgcggaaaaaagcaagcgccgtccggaccgccttgtcggtcagatagctttcccggccggccacgttgtaggggatgccctctttttgaaagcactcctccagcagcgacgcctgcctgtgcgtgcggtacagcaccgcgatatctccaaagccgcgcggcgcggactcctcccgcatgggcgcgccgccctgccggtgggcgtcgagcatgtcgatgccgcccaccatccggttgatctccctggcgataaacaaagcctcggaaaacggggtttcggccgtgagcagccggaccgcgcagccatccggccgcatagcccccagccggcgcgtttcgcgctcctgcggcggcagaccgcttgcgatcaccggcagagcgcagtcaagaatctgcggcgtggagcggtaattttcgtttaagcggatcacgcgtccgtccgggcagtcgcgcgcaagcgtctcaaagcaccgggggtccgaaccgcggaaactgtaaatcgcctggtccggatcgccgattacaaacagctcgtccccgtccctgttccatgcgcgcaccagccggtattgcattgggttgatgtcctggaactcgtcgaccagcagccgccggaacggttcgcgctcctgtccggcgagcgcgccctgttcaaaaagcgcaagcgtttgcaggatcaggtcgtcatagtcgaggacgccgtattcctccaggcgttcgcagtagtatgcaaacagcatttgctccgcttcatccgcctctttcccggcggtcagcccgttctttcgcgctgaaacagcggccagcgcatcgcggggcctttttttcagcccaagctctgcgcaaagttcctcaacaatggccagcgccgccgtctcgtcgatcagcgtcacatcgcccagcctgtccctgagcagcttcatgcaaagcccgtgaaaggtccccaccgacaccttccgggccgtccgcctgccaagctcctgttccagccgtccggcaagctcggccgcggccttgtttgtaaaggtcacggctgtgatctgccccggcgcggccgcgcctgtttcgatcaggcggcggatacggtacacaagcgtgcgcgtcttgcctgtgccgggtcccgcgacgactgtaatttgccgcccctgcgcgctgaccgcctcccattggcgctcgttcaatccgtaatgcgcggccgcatctgccaaaacggccgcatgtttttgcgcgcccaggcctgcggccgcctttttcggcgcatcgtttattggcgcggccgctttttttcgggacggtttttcgccgctccccgcaaaaaagcttacctgaccggaataggcggcgatctcacgcgcgtccagaagcgcggcccgcccatattcgccgtcgtatcccggctcccaggcgacctcgccggcgcgcaggcggcgcacgccctccgccacgcagggccccgccagcctggaaagctcctcaagggggatctgccgcaggaccgaaagctccgggccaagctcccggagcagctcctcgtaccgggcctgcaccttcttgcttgcgggcgtcgacccgatgcaggcggcgattgtctcaggcagcggaatgatactctcaaaatccttcgccagcttcggcctgaacccctccgggcggtcggccagctcctccacgcggtgcagcacccccacggtgatccgccgcccgcagaccgggcagacgccgcccgccgcggccgtctcggccggcgtcaggcacaccttgcagccgcggtgcccgtccatatggtatttgccctcctcgggataaaattcaagcgtccccaaaaattcgtccgtttcaggatgcgccagcgcgtgcgcaatcgctgagaaggaaagctccgtattgaacaaattggcctcccgcgcgagcttcgacggggaatgcgcgtccgagtttgaaacgagcgtgaaccggtcgagcgccgaaatacgccaattcatcgggggatcggaggaaaggcccgtttccagcgcgtggatatgcggcgtcaaatcgccgaagcacgcctcgatcgtatcaaaacccgaatacgctccaaacagggaaaaatgcggcgtccagatatgcgccgggataaagattgcgcgcgggcagatctccagggtgatttccagcagatcgcggctgtcaagccccaaaatcggcctgccgtcggaatgcagattcccaatctgctccagccggtgagagagcgcgtcggccgcttcaaaatccggcagcagaatcacattgtggacctttctcgttttcccgtcctttttgtagatggagctgatctccgtgctcaataaaaaacgcggcctgcacgccgatgaatcgaacgctgcggcaaagcgccggctcgcgccggacgcgccgccgggcagcgccgacgcgtcggccctgtacgcgtccttgaggacaaagacgccgtcgcccgccggcgcaagcttttccctcagttcctcccgccaggcgggatgcgtaaaatcgcctgtaccgatcaggtcaagcccctttcgcctggcccaaaggtcgagcatttccggaatgcagtcccggctggtcgcccttgaatatttggaatgaatgtgaaaatccgctgtaaaacgcatcgatgaccgtcccctttccatatccataccgccgcgtcctgttacatatgcgctgcggtccactgctccagcaccgagagctgctctggcgtgtgaaaccaatgctcgccgttttccatcaccgttaccccgcagccaaaccggcgggcaaagacgtccaccgtctcacgccccgtcagattgtccccgccggcatacaaaatttccgtcggcacatcccactgcgcaacagggtgttcccgcgcatatgcaagataacgccacgacagcgtttccccgaaatccgttgcgatctcgccctcacggcgcaggcgctgttcgccgacgcccgcccagcgcatcatatcacagatcagccgctccatatcgagcaccggcgaaacaaacagcgcctttataagcggctggccggcaaacgccagcatggaaaaccaggcgcccaggctggttgcccgcagggccgcgcagggccagcgccggcgcgcccagtccaataccgaccgcagctccgggaccgcgtgccacgggtcgaagcccgcggggccgccgcggcgcgcgccgtgctccggtaaatcaatggccagaacctgccagccctcagggcagacgatacgggcaaacggctccccctcctccttgcagccgtacctgccgtggacatacagccagacgcgttccgcctggccgccgtaaagcacggcggggagatctcctatcctcattgtttcattcgtcatatcatttacccttctgtgttaaaacaaatttaaaaaaatttcctgttcccattctataaaatccaatggctgccagccgttgtactccggctgtttttgggcatactgaacccaggctgcgcagaatgataaaaaaggagaatgatcgatggaacaaaatcaaattggtccgtctctggcacagaatacgcttgatcaaattccgtcccccgctccaaacgcccgcagaatcaccgcgctggtcaagcagcgcggcaaggtggtcggctatcagctctccgaccacaccacgcttggcaagcagcaggcggtcgagctggcgcggcagggcggcatcgccggcgtcggcatcgcgcaccggggcgacacggaatatctcaaatccatcccggacggcagcgagcagaacaatttgagcagtctgccctccatcccgtcggcgcagtaaaagaacaggacgcgcccgcagcgtatcgctgcgggcgcgcttttggggaaacagcgcctctcataacggctgctatgaagcgccttcctgtgccggccggtacctgcctcctctgccggtatcaggaattgtcttttcgacaggattttgcatgatatagtcggccagctcctgaaaaagctccaaatcatcataggagaaattggcatcgtcatccaatatgatagtgacctcatatcccacattctccgggattccggggtatattgtgtagagcgtaaagtccaggaccccgttctgctcgtcctcaaccagcagctcaataaccgggccgccgtttctgacatcaatatttacaccggattcaagcggttgtccgttctgtacaagctgcagaatggattccatttccttactgtcgtcaattcttttttgtccataaacacgggtcgccccccggtaggtaagcgtcacgaacgtctgcgcataggcttcaaaactgagcatgattgacagcagaaccgaaagcagtcctatcagcgcataccgtttcataaatattcaacctcccgcaaacggcttaaaagcaacggatggtctggcgcgcatatcaggtcgtaattgtggatttccaattgtaggttaagcccccatatgtatattggaacccgagcttctgagacggctgaccatttttgtagagccatttgtaggcgcccgtatttgaatcactgattcttatgccgtatcgagaggccgaggaatcgcttgaataaccgcaaaacgccgtggagtgcccatatctgcggttcacctcgagccagtttatgcagcccggacgctgtttactcacatggggctccatctgattcggggtcaaaacgccctgcagcgtgcctttaacgccatagcaggtatttagtgcatcgacaatatcttgatccgaaccgcccgcatcatatcctatgcccattttatcacaaattgcaaacggtgtataggcattattttttgtaataaatttcccaatcagcatagtggcggccgcccaacactcaccgcgtgtctgtttataagtgcctacattaatgttggccacatatgccgcccttgtctgcggcggaattgcaaggctgtacttttcccgatctgaataatattcagtctgatcgctgttttgcgcggcaaggatgctctctgcagacggcgaatcagcaacagcatttacttccggcatggcaaaccggtattcttctatcagctcggcttcatcggaagtcttaaagaacaactgattttctgttactacgatgcaaaattccgaacgattactctttatgtattcatcgatttgagacgcccattccgaaccgaaggaatatgtcggatccgatttgtttccgtgaatccccaaaactccaagtatctcatgatctgaataaacagggtaatagcttgcagaatcaaatgttacaagtgatgaatctacatattcgtaagcagggattttatcgccgacttgtacactgtctatgttttcggatggcccatccgttgacaaccaggcaagcaataaattttgaatacatgaaatgtcattatcagaaaaaacgtttctgatgccgcctgattccggttcctccgcacacagaggcatgcacatcacaatagctgtggaaagcgccagcaaaatggagatcatttttttcattctttgccctccttaactttgttgggttatttttcattattatacaattatttataataaaagtaaagtatttacagtaaaatttttcaaattaatagattcatcaagcaacggacgcgccgctttctgcgcgcgttcaaatcgtcacttctctttgataaatacaaaacggtccgccccggaacgggcggcgtcgaaccggtatcccaggtcgcaaaaatctttcagcccctccggctgcataattgcatgttcagcaataaaacgcaccatttgaccgcgggccattttgcaaagcgtgcctttttccaccacttttccattgacagcttctccgaacacacagttaaccagacgcaccggccccggcagatgcgcctgtacggcacggctgtattctttggaagccagattgagcacccagtccgtctcccgcgccagagccagggccaatttgtccccccaaaacgcgtataaatcccgatggccatcgacagccaggcgcgcctgcatctccagtcggtaagggaccacgccgtcaaaggggcgcagcaacccataaaagcctgagaggatgcgcagatgctcctgaataaattcaaattgtcccgtttcaaaaacccccggcgccatatactgatattggatgccctcataggacagaatcgcgggcgtcaaatcccgctccagatccatatggcgcagccgctccatattgagggctgcgatggcgtcgttgcagttccaaagggcttgcagggccggccccggcatggcgcgcagcgcggacagcaaccgccgcgcctcgggcagaaactgcggcaggccctccggcgcaaggctgtcggtatccacgtgcatctttttggcgggcgaaatgatgatccgcatggctgtctcctttcagaacggctaaacaagaaccattccgatcataccacataccgcgccgtttgaaaatgcctgtgatttccaagtgcttccaacgttcgtattgtcattaccccaactgtcaaattttataaaattttatatgattagttattaaatatacataattttccgaatttaatgaaagggattgacaaatgcacgctgctgatttaaagtatagaaaaatcaacattcaaatgcagcgaccaggatacaaccgtccgaagttccccgctcccagagagccggcgttggtgcgagccggcagcggtttcggcggctatcacctgaaagcagcccggtgaacaggttttcccctcagtagccgcgggccggagtcccaccgttatccgggagcatggtgccctccacagcggagaagccatggcagagcggccgccgtcctggcggcaaatgaagtggtaacgcggaggcttgccttcgtcttcagtcgaccggattaatatttccggcgcgggagacgaaggcttttttatttgcagaagaatgttgagcgcatattgaggaggcaaaaatcatgaatgtgcttgttatcatcctgatctcggcagtctgtctggtcggagcctatgtgctttacggccgctggcttgccaacaaatggggcatcgaccccagagcaaaaaccccggcctatacccatgaggatggccaggactatgtccccaccgacggctggaccgttttcagccatcagttttcttccattgccggcgccggccctgtcaccggggccatccaggcagccgctttcggctggctgcctgtgctgctctgggtcctgctcggcggcatcttttttggcgctgtcaccgacttcggcgcgctttacgccagcgtcaaaaatgaaggcaaatccatgggcctgctgatcgaaaaatacatcggcaagctcggacgcaaattgttcctgctgttctgctggctgttcaccctgctggtgatcgccgcctttgcagacatggtcgccggcaccttcaacgcctatgaaacggccggcggcgcgacacagctcgccgctgccgcgcgttccaacggtgcggccggttccatctctctgctgtttatcgtattcgccatggcatacggcctgattcaaaagcggatgcacttcaccggctggaaaaagacgggcctgggtcttatctgcaccgccgccgcgctggccggcggtatgctgacgccgctcatcgccggcaaggaagcctggacctatatcacctttatttatatcttctttgccgccgtgctgcccatgtggcttctcaagcagccgcgcgacgccatgaccacctatatgtttatcggcatgatcgcaggggcggctctgggccttctggtcgcccatcccaccatgaatctcccggtttttacagggttccacaacgacagccttggcaatttgttcccgatcctgtttgtaacggtggcctgcggtgcggtttccggctttcacagccttgtttcctccgggacctcctccaagaccgtttcaaatgaacgcgatatgcttaaggtcggttacggcgcgatggtgctggaaagcctgctggcggtgctggcgctgtgtgtcgcgggcgccgcggcggccgctgacggaacgcccgcggcagggacaccgtttcagatcttctcaaacggcgtggctgggttctttgaaatgttcggcgtcccgctctatatcgcccagtgctttatgaccatgtgcgtctccgcgctggcgctgaccagcctggacgctgtggcgcgtatcggccggatgagctttcaggagctgttcagcgttgacgacatggcaaacgccgccccctggcgcaggctgctgtgcggaaaatatttttcaaccgtgctcaccctcgtcctcagctttgttctgacgcgcatcggttattccaatatctggccgctgtttggttcagccaaccagctcctttccgcactggtgcttgtgacgctctgcgtgttcatgaaagtcaccggacgcagcaacaaaatgctctttccaccgctggttatcatgctctgcgtcactgcgaccgcgcttgtccagcgcacggtcgggctggtcaaagctttttccgccggaaacgcggtctttcttgttgaagggctgcaactgatcatcgcccttttgctgatggttctaggcgtcatcatcgtcgtcaattctctgcgggtttatttctcctccaaacgcaattccgagacaagacccaccgtacccaacaagacgcgcaccgcttcctgacacgtgacgataatcaaaagcagagcggatgcgcctcgcctgcgctcctaatcaaaaagcatcggaaggccggctggccttccgatgctttttatactatgttttttgttcaggcggccgtccctgacctctattgcgtctccagtcccattaaaaggagcgggctgccagcccgctccttttttgattggttaatcgtactggagaaactccagttcaaatccgtttggatcgcgcgtcagcccgccggaaaagcccagcttttccacatggcttaccggcacatgaaagagatatcccgcatccgtgagctttttctcaagtgcgtacacatcctccacttcaaaggccagatggcgcgcccggcccttgtccgttgccgtattgccgcagtcagccgtttcataccggtattcggtcagctccaaacgcccgccgcccggcagggcaaaataccgcagaagatggtcgcccatatcaacatccggcaggcgctcaaatcccagcagctccccgtaaaaccacagcgatcgcgcaacatcttttaaattgatggtcacatggtcaatacccttgatccgcatccaggttcctccttttgaacatcttgttcaaaggtttgtttgagaaattaaaattgccgtctattttcaaacaagccctagtagctgcctgcctgcccgccggtgagcaacgtgacggcggagcttgttccgatgcgctcgcagccctccgccaaaaacgcttttaagtcctccgcattcttaacgccgccggcggccttcattttgacatgcggtccgatatgagccttgaacaggcggatatcctccagcgtcgcgccgccggttccaaaacctgtggaggttttgatatagtcggcgcccgacgccgtcacgacctcgcaaagcttgatcttttcctgctcggtcaggtaacaggtttcaataatcaccttgagaatatgatccccgacggcctccttgacggctttaatctcctccagaatggcctcgaagcggccgtttttggcgtcggaaatattgatgaccatatcgatttcattagcgccgtctgcgagcgcggcgcgggcttcctccaccttcgcggaggtgacgctgtagccgagagggaacccaatcactgtgcagatattcactcgtccgccataggcgtcatggatacgcttgatataacagggcggcacgcagaccgacgccgtatgatattgggccgcttcatcgcaaagcttctgaatatcctgccaggtcgcaaaggcttttagctgcgtatggtcgatgtgttttaaaatttcctggttcgtcatactggttccctccatgaatatggtttttaaactattccaccggtgcgacaatcagctcggctccctgcgcctccagctcccgaaggtcgtcggggtcggcatcactgtcaatcacaatggtatccaattgatccaaaggagcgatttgggcaaaggtcacgctgcccagcttgctgctgtcgcaaagcagcacggcctgggagctgcgctccaggatggcagctacattggcggccaaatgaaaatccggcacagtcgcgcccatcgcagcattcagtccgttgcaggtaaaaaacagcttatccaggctgacccgcggcagcggcgtacctgctgtgttcacataatggaagccattgcgcagcacgcctcccagcatgaacagcgtaaaattggtgtgctcctccaagaaggaagcaagccggatgtcgttgagcacaaccgtaagcttttccttgtgaatgagctttcttgcaaattccagggtagtggtccccgatccgatcgcaatgatatccccatcgtccactaaatcaaccgcagccctcgcgatcgcttccttttggcgaagcatctgtgtctgctttgtgaccggcggcggttccaggcttactttgctgtttcggatcgcccccccatgtgtgcgggtgatcagcccgttttcctgtaacacacgcagatcgttgcggatggtggatggcgataccccgaaataattgcacagctccggcacgacaattttctgatttttactgatcagctccaaaatctgctgcttacgctcctcagcaaataccgtttgtctccgctcctccaaagcgcaccctccttcacagacaaaatgaaccattttttctattatactgtgcgcgcgacaaagccgcaagcgttttcaggccggggcttttcagcgtgcggcggcccctggccggcgcaatgagaaccgccgcgccgggacctgcccattttgcccgcatattgatttgtaaagcgcacctcatggcagcagatagataacctggcgcggtttcttcatccgcattccgctaacaggaatgcagtactgctcaagattattatataacagtatacgataacgttcaatataaaaaagcaacaaaaaacaattgtcaattgtgtatattcctataaaacgagagttatcaccaattaaacttgttgacttttattgcatccggtgatatgatgtggaacaaagaacagcaaacaatcaaaaacgatacaaatcaacaacaaccatttccctggaggacccatttttattgatgaatgttaatgttcaggaggctctgctttgaaagaagataaacggattgaactcaatctttttgccgcgcggctgcgcctggaaagtatcctttcgatggcgtcctgcggttccggtcatgtgggcggggtgctctccgcggccgaactggtggccgtcctttacggcgaccaagcgcgttaccgtccggccgaaccggactgggacggacgcgaccgcatcgtcctttcaaaaggtcactgcggccccatcctttacgcggcgctggcgcttgaggggtttttcccaaaggagctgctgaacacccttaaccagcccggctcgacactgcccagccattgcaatatgcacgatacgcccggcatcgacatgagcacaggctctctggggcagggcgcttcgcttgccgcagggatggcgctggggttgaagatgcgcaaaaatgacgcctatacctatctgattttgggcgacggcgaatgcgacgaaggtcaggtatgggagatggcgctctttgcagcccaacaaaagctggaccatctgattgcatttgtagatctcaaccgccagcagctcgacggctatacggatgaaattttagcgttgggagatctgcgccgtaaattcgaggatttcggctggcacgcggttgaggtggacggacatgacgtatccgccattcacgacgcgatcgaagatgccaaaagccgcgccggggtcccctcgatgattgtgctcgacacagtcaagggcaagggctggagcgtcacggagggccgtacaggcatccaccatattccgattacgccggaacaggccgcggccgcaaaaaaggaattgggcgcgcaaatttcggctttgcaggcgaagctgcgggaggtgtgctgatatggaatttgcaaaaagcagcctgctgctgcgcgaagtcaacagccaggtgctcatgcagctagccgaacaggacggccggattgtgctgctggacgcggatttgatgaatgcgtcggcctttcatcaatttgcggaccggtatcccgaccggattttcaactgcggaatcgcggaaagcaatatgatcggcgttgcgggcgggctttccgccgtagggatgattccggttgcgcattcctttgcctgtttcgcgtcgcgccgtgtagccgatcaaattttcatgtccggcgtctatgccgggcagaatataaaaatcatcggcaccgaccccggcgcctgcaacaccgcaaacggcggttcgcatatggcgctggaggatatcggcatcctgcgttcgctcgccggaacaacgatcgtcgatcccacggatgagacgatgcttcgcagcatcctgccgcagatcattcaggcgcctggcgtcagttacatccgcctttaccggaaaacgaacctgaaaatttatccggacgggaccgccttcaccctgggaaaagcgcataccgtccgggcgggcagcgacatcgccatcatcgcggaaggccccgtgatggttccggaggcgctcaaggcggccgagctgctggagtctgaaggcgtcagcgcccgcgtgatcgatctgttcacaatcaagccgctcgacgccgaggctgtcgccgccgccgcccgggaaaccggcgcggtgctcaccgcggaaaaccacagcgtttataacggactgggttccgcggtcgcagaggtgctggccgagcgccgactggccgttccattcggacgaatcggctttcgcgatgtgaccggcgagacggcggacgtgccctatatcctgaaaaaattcggcatggacgcgccggcaatcgccggcctggcaaaagagcttgccgctttgaaataaatgacaggaggcgtaccatatgaatcaattcggaatccattatgcgtactggggcaatgagtggaaggtggacatgtgcgaacgaatccggctggcggccgacgccggctttgacgacctggaggtcactccgcccgattttatgaccaatctggaaaaggacaagatgaacgagcttaaacaatgcgccagcgattacggcgttgaaatgagcttctgcatcggatttcccaagtccaaggatatggcctctcccgacccgaaagtccgtcaggccggtattgattattccaagcgcatgatcgaagccgccgggtatatgggcggcaaaatactctcgggcatcctgtactcctggtggccctatctctatgacagcgagattaccccgcagtacaagcgggactgttggaaacgcggcgtcgaatctgtccggcaggtgatcccctttgccgctgatgcgggtatggtttacgctgtcgaacttgtcaaccggtttgaacagttcattgtcaacagcgtggcggaaggcaggcagttcatagcggatatcggccaccccaacgcaaagctgttgctcgacgtgttccacgccaacattgaggaggattccatccccgacgccatccgcagcgcaggcccgttgctcgcgcatatccacatgagcgaggccaaccgccgcctgcctggctgcggcggcaacatcccctgggcgcagattgctcaggcgctcaaggatatcaattatcagggacgcatcgttttggagccgtttgtagcggcgggcggccctgtcggcaacgatctgcgtatctggcgcgacctggatgcggatgtatcaaaagaggcgcgtcatgaaaacctgaaaaaatctctcaagtttgtcaaagagctgatgaagtaagcctgctcggaggtgaagatatggcatatctgcttggagtggacctgggcacctccagtgtaaaaaccgtgttgatggatcatcacggcaagctggccgctatctgccagcaggaatatacatttgacatcccccgggagggctgggcggaacaggatcccgtggtctggtggcaggcagcggttgcgacgatccgaggcgcgctggctcaggcggccgtttcgccagacgacatcgacggcgtcggcttctccggacaaatgcacggacttgtcccgctcgaccggcagggccagcctgtgcgcaaagcgatcatctggtgcgacacccgttccgtggacgaggtggaggatatccgccggctgctcggaaacgaacggcttggcgaaatcacctgcaaccagatcgccgccggatttcagactgcatccctgctgtggatgaaaaaacatgagccggcgctttatgagaaaaccgagacggttttgctgcccaaggattatctgcgctaccggctgacgggctgtctttcaaccgacgtgaccgacgcggcgggtacgctcgccctgaacgttcgccaggcggcatggtcggacgaattgattcggaccctggggctgcgccgctcgctttatcctaaaatttatctcccgcaggactttgctggcgaggtcacagccgcggcgtccgcagaaaccggcctgaaagccggcacaaaagtattccatggcggcgcggatcaggtgatgcaggcaatcggcaacgggatcatcgcgccgggacaggtatccgtcaccatcggcaccggcgcacaggtattcgcgcccatcgcctctgcgatttatgataagcagctgcgtgcgcacaccttcaataactttcagcaggacagctggtatttcatgggcgcgaccctttgcggagggctttcgctgcgctggctgcgggacacggtgctgggcggtatgccctatcgcgagatggacacgcaggtggaagcggttccccgcggcagcgatgggctgatctatctgccttatctgtccggcgaacgcacgccgcacatggacccgctggcccgcggcatgttctttgggctgaccctcaagcatagccgcgcgcacctgatgcgcgccgtgatggaaggggtggtgttctccctgcgcgactgcctggagctttatgagcagctcggccagagctgccggcgcgtgattgcctccggcggcggcgcgcgcagcgcgccatggctgcaaatgcaggcggatatcttcggcaaagaggtttatacctccaaaatgctcgagcaggcgggcgttggcgccgccatctgcgcaggcgtcggcgcgggcgtgtacgaaagctggcagcaggcctgcgacacagtcatccgctggaacgatacgccggccgttccggatttaaagggaacagcccgctatgcagaatacagggagcttttccgcgcgctttaccaatccaaccgggaactgatgcatcgatgcacggccctttcccgccaggaaaaatgaagcaaaaaccaaacaggttttcgttatcaaccatgtaaacaaccgcagaatttcaaggaggaatcagaaatgaaaaaagcgatatccctgatcctggccgccacattggcgatgggcgctctggccggctgcggcggcgcctcatcctcggcctcatccgcttccggcgcaggctctgcgcccgcttccccgacagcgtccgctccggctccggcagaatcgtccgaggcagcgtccacaccggcgggcgacgaaatccgcgtcgccatggtactaaaaactttgtccaacccgttttgggtcgatatggcggacggcatccaggcggaggccgaaaagctcggcgtgacagcggatattttcgctgtcgacgctgaaactgacatcgacggccagcttaaaaagtgcgaggacgccatcaacagcggctcctacgacggtctgggcgtcgcgccgatcacagcgaccaacctgatttccgccgttgtggcggccaatcaaaaggggatgcctgtggtgaacatcgatgcgaagatcgatgaggacgcgctcaaggaggccggcggctatgtggtcggctttgcgacgagcgataaccacaaggttggcgcaatcggcgctcagtatatcatggaacagcttcccgacggcggcaaggtcgccatcatcgagggccgcgccggcgacctgtccggcgagcttcgccgcgacggctgcaaagagacgctggaggccgacggttccggcaagtatcaggttgtcgatgtgcagccggcagattgggaccgccaaaaggcgctcgatgtcgccaccaacatcatcacaaaaacgcctgacctgaacgcgttctttgtagccaacgacaccatggcgctcggcgttatgcaggcgattgccaacaccggaaacaccggcaagatccttctggtcggcaccgacgcttccgatgaaaccaaggaggcgatcaaggccggcaatatggtcgccgtctgccaggaccccgcagcgatcggcgcaacctgtctggatattcttgtggacgccatcaaggccggcgaaaccggctccccggattatgaagctgtatccaaactggtcgacgccaacctggtcacaaaggaaaacgtggcctgaccgcctgttaaaaacgcaattcagggcttgtttgaaaatagcggagttgccgacttttcaaacagcccccagcggcagcatgacgaaggcgctgtttttaagaaaaaacagcgccttcgtataaagggaggcgcgctatggaaaagatcattgaaatgaaaaatattaagaagctgttccccggcgttgtggcgctcgacgatatcacctttgacctttaccccggcgaggttcatgtgctgatcggcgagaacggcgccggcaaatcgaccctgatgaaaatcctcagcggcgtttacactccgacagagggaaaaatgatcatccagggcaaggaatacagccggcttaccccaaaggaatcaatggaacaggggatcagcgttatttttcaggaattgagcgtcattgacgagctgtcggtggcggaaaacctgttcgtcggcaaactgccgcgcacaaaagcgttcggcgtgctgccgatggtggatcacaaatatatatacaaacgggcgcaggagctgttggaccgcgtagggttggcggtcaagcccaccgctatggtggaaacgctctctatttcacaaaagcagctcgttgaaatcgcaaaggcgctggccgcgaacgcaaaggtgctgatcatggacgagcctacctcctcgctcaatctggatgaggtggaaaacctgtttaagattatccgcagcctcaaggaaagcggcgtgggtattgtttatatctcgcataagatgcgggagctgcgtgagatcggcgatcggatcaccgtgctcaaggacgggcggacggtcgccaccaaaaatattgaagatgttgcttccgacgaggaaatcgtctccatgatggtcggacgggagctgaaaaataattactttaaccgtgagatgtcccatgttaaggacaaggtgatctttgaggcaaaaaacatcgtccgccgcgaccgcagagtaaacgatgtgagctttactctgcgcgagggcgaaatcctgggctttgccggtctggtcggcgcgggacgcacggagctgatgaatgtgatcttcggagcggagcggatgcagtcgggtgaaatctggctggacggccggcgcatttttgtgcgcagcccctatcactccatcaaggacggtatcggtatgatcaccgaaaaccggcgtgaaaccggctttatgcacaattttgagatctggcgcaacatcgccgtcgcccgttctctcaagcagtcgcggctggaaggcacatggggtcttaccaatcagaaacgcgagattgcgcttgccgaacagttcagcaaaaaaatgcgggtcaaatgcaccagtgtgacgcagatgatcaccacgctttccggcggcaatcagcaaaaagcgatcattggcaaatggctggccgcggacgcccgcctgctcatctttgatgagccgacccgcggcattgacgtcggcgcgaaaaacgagatttatcaaatcatgcgcgatctggccaatgagggcaagggcattctgatggtttcctccgagctgccggagctgctttctgtctgtgaccggatcgtggtgttcggcggcggaaaaatcaaagccgtttttgacgcaagggaagctacggaagaaaaaattatgcttgccgcaacataaggaggaacacgatgcaaaagaaaaatttcgcctattactgggaacgtatcggcacgcttatgatcttcgtttttatgatcctggtgacctccgtttttgcgccgccgcagtttttgtcgccgggcaacctggtacagattctcacccagagcgcaacgacgatgctgatcgcctgcggcgagttctttgcgattttgattgccggtattgacctgtcggtcggctcggtgctcgcgctttccggtgttgtcactgcaaaaatgatggtggcgggcatgccgttcggcctggccgtgctgttgggcggcgtcggcgtcggcgcgctgctgggcgcgatcaacggcgcgctgatcaacttcaccaagctgcatccgttcatcattaccctgggtacgcagtctatatttcgcggcgtcacaatgatcatttccgatgcaaagcccatctttggctttccccagagctttaaaacagccttcggcggcatgatcggcggcaaaattcccatgcctgtggtgtgggcgctgctggtagctgcgattttgtggttcgtcaccaccaaaagcaaaatgggccgcaacttctacgcgctcggcggcaacaaggaagccgcctggttttccggcatcaacgtccgcctgcataccctgctggttcacatcatctccggcatctgcgcgggcatctgcggcgtcgtcatgatcgcccgtctcggctctgccgaaccgatggccggctcgggccatgaaacctttgccatcgcggcggcgatcatcggcggcaccagtttcttcggcggcaagggcaaaattccaaatgtcattgtcggcgcgctcatcatcggcctgatcaataatgcgctcaacatgctcagtgtcgaaacttacttccagcaggttgccaccggcgcgctcatcatcggcgctgtgacgcttgatatgttcatctcccgcaaaaaataaggatcttcatcattttattccttgttattgcttttagaacctgtattcacacccggaggatactggacaggcgagggattttgtacccgatcaaggcaaatttttgcaggcgggctgtcgcccggcaagaaaatttaacgtggagcgggggcaaaaggcccgcctggacggcgttttgcggctgtgaatacaggttcttaatatgtgatcctcctaaccgtacaggcccgggctgttttcagcccgggcctgtgcgtctgaccgcgcctgcctttttcaccgccgcgactcccctgcccccaacaacgggatgtgctacaacgcaagcatacaaaacatgcctgtatggaaacggttgcaaacgatgagaaagcgcggtatacttatcgcagtgtgcactgtagtgttggagtggattgcatatgcctgccatctgaaaaagatgtgccgcattacaatgcgatatggacggcatcacgaaattgacaatcggcacagttaatggaagggaggtgcgcacattggcagagaaagcaggcattcaggcaaagcccattttaaagtgggcaggcggtaaaacacagatgttaaatgatctgctgcccaaggtgccggactcttacgggcgatatatagagccgtttttcggcggcggcgcaatgttcttcgcgctgcatccggaaaacgcaatcatcgcagacagcaatccggagcttatcaatctgtaccgtcaggtcgccgggcatgtagacgatgtgattgcttatcttgagaaatatgaaaacacaccggagcgattctattctgtccgcggacaggaatggctggccctgcctgaggccgaagcagcagcgcgaacgattttccttaacagaacttgcttcaacggcttgtaccgggtcaataggaagggacaattcaacgtgccttatgggaaatacaaaaacccgaaaatttgtgaccgggaaggcttgtatgccgcagctgaagccttgaaagctgccgaaatcgtatgcagcgattatttgcctgtgctggagcactatgcacggcctggtgattttgtattcctcgatcctccatatctgcccatctccgaatatgctgatttcaaacggtacaccaaagaacagttttatgaggaggatcatgttgagctggccaaaatggttatccatttacatgagcgcggctgccatgtgcttctgacaaattcaaaccatccgctggtccacgagctgtatgctccattcacaatcgatgtgatccaaacaaagcgtcatatttcgtgcaacggcaacacccgcaaaggcgaagatgtgatcgtaacaatcccgccgaagcaagcctcgcggctcaggccgctttccgaaccgcttcccgcccaggttgcctgctatccgcccacgcgcttcatgggttcgaaaagcaagcttctgtctgaaatctgggccgttgcgtctcagtttaaatttgatacggtcattgacctgtttgctggttccggcattgttggatatatgttcaaggcacagggtaaatctgtggtcagcaacgactatatggccatgtcctctacctttgccaaggcgatgattgaaaacaatacggttactctgccaatcgaagaagcgaaaagcctgttgatgcagcataagccgtccgatcattttgttgcggcgacatttcagggcttgtattatacagacgaagaaaatgagctgatcgatattctgagaagcaatatcgccgatatcaaggaaccatacaagcatgcaatcgccatgaccgcccttatccgggcctgtacaaaaaaacggcctcggggaatatttacatacactggagagcggtataacgatggccgaaaggatctgaaaaaatcactttcgaagcaatttttagaagccgtggaagctgtaaacaaggcggtatttgacaatggaaagcagaatcgttcccggcatggggacgccatggatttacgtgttgagcacgccggtctggtctatatcgatcctccgtattattcgcctctgtcggataacgaatatgtacgcaggtatcactttgttgaaggtctggcaagggattggaaggatgtcgaaattcaacagcacacgcaaaccaagaaattcaaatcttatccgacgccattctccaccagaaacggcgtggcggatgcgttcgaccgcctgttcaaaaaatttgcaaacagcatcctgatcgtctcctattcttccaacagcctgcccacccaggatgaaatggttgcaatcatggccaggtacaagcagcatgtcgaggtgattcccatagactataaatactcgtttggcaatcaaggctctgcaaaaacgcacaggaattccgtacaggaatacttattcgttggatattgacagggggagccgtatgaatgcaaaaatcgatatatggcttgtaggcaataccggtttgcgcaaccccaatcgaattcaggagggccttgcagtttttgctaattcttcttatgtcggaaagctccatggccgcgatcatgaaatcggatttatgaaactgcttaacgaaaaggggattatacaaaatgaaagcggaaaagacgagtctggcagccatgccagaaaatggaggctgatgttctccaaaaacggttttatttatccgcaggtaaagaaaaaagacggcaaccaagctgatctgggaagcatggacgagcttaccccatttggaaaggtctttttgcaggcagatacatatcctgctattcaggaatgcttccttcgctccatgagtgtcgaacagttccaaatgcccgacggtatccactttttttcgccgcttaggtggctgttggcaattatgctggagcttgagcgcagaaccggctcctctcaactcagcaggcttgaatttgcattatggggacatacgacaaatcctagctgcgatctgaacgaggtcgtcgatcatattctcgatctgcgcgagcgcagaaaggcagccccggccaaacggctgtttgacaaaggtgaaattgccaagcgcaaaaaaagctatgataaaaaggcggataattttttagactatagcgacatgaatatgcgataccttcgtatttccggcgtttttcagcgcaagggccgcggccttatgatcgccccagccaagcatgtcttagcagaaaagcttgccaaaatcaccccggcaaacggctccatcatggatgcgtacaggacgctttgcgccggcgcgccattgccgacggacgatatggaggttgcaaaggctctgcttgatgatctggtaaaacagatgaatgcccgccacattgtttttgacatttcagacctgccatttactacgcccgcagaaataaatattgcaagacagcggcttgaaagcattatgtcccaaacggatgagatcagctatgcagatgcgcaatgccgccaatggaaagaaatatcggactatatgacccttctcatcaaaggaggcggcagaaaggaatacgatgaagatcatgtcatcgaagttcccaaggatgaaacccccgcttacctcgagtggattatgtggagagcggcgttggcgatcgaccatatggttaataagccttatgaggcgcgcggctttcgattggattctgattttttgcctgtttcagccgcagccggcgggagaggcgatctgtattgtgaatttgaggactttacaattttaacggaagtcacaatgtcggcatcatcccgccaggaggccatggaaggcgagccggtcaggcgtcatgtttcggacgccgtcctgaaatacaataaacctgtatatgggctgttcatcgccataaggattgatacaaataccgcggaaacgttccggcatggcgtctggtatgccaagggggatgaaaagcagcgtctgaacattattccgcttacattggcgcaataccaaaaatactttgaggcaatgtttcaggcaaagcaggccgctcccgaacggctcagagagctgattacggaatgcgcggccgccagagatcttctggaggcgcccgcctggaaactgtacattgacacgacggtcagcggcaaggcggcggagctttcgctcagaggcaaaaagcatgcggcgcagcgccttttgccataggcgtctcattcttggcatttgaagcaggatggacagaataccgatgagccggcccagtttcatgtcattccaccgccttccctgcatctatttgcattatagcatagaaaccagacaacggtctgtcatgtttctttccgtcttgttctttttgcgcccactgggtacaatagcggtaaaggagctgaatgatatgggaaagatcgttttgtatcttgccatgagcgtggatggatatattgcggacgaacagggcggcgtgggctggctgggcggcgtgggctggctgggcggcgacggcagtgaaccgggcgcccccggcagttacccggcattttacgagacggtggataccatcgtcatgggttggaccacctatcatcagatcatcacggagctcgctttggaaagctggccctacccgggccgtccctgctatgtggcaacacaccggcgcgagcaagacagggagagtatctgtttctggaatggaaaactcacagtcctggcggacaagctgaaggcagagcgtgaaggtaatatttggatctgcggcggtgcgtctgtggctgggcagctattgaaagaaggccgcatcgataaactgtggctgtcggtaatccccgcagtactgggcaaaggcgtgcggctgtttgcagaacaggggcaggaactgctgctgaagctggtgagaacgcagcattacaacgggatcgtggatctggtgtatgaaaagcggtgataaacgatgagtaatcaatttatcaatctgacagcagaaaatctgatgcaggagcacctatgctgtatcatccgcagcaagaaaccccatcccggtgtggaggccaagcggtcttggctcagcgagcggctgaaagaaggccatgtattccgcaaactggacacaagggaaagttcgcgacggtgaatctgctggacgccgccgctttgaagcggtttttgaaaaagggcggatatggtgtatctgcaaagtgagctgtaaaataaagccgggcatctatttgggctggcgcgccccttgttaagcaggccggagaaataataagggtcattgaatatcccgttgttgactgtgttgcgaaattattcacaatatttgatattggcagcaaagttaaacttctgcactttaataaatgagcagccttatattaagcctgtcagttttcagccagcaataaacaaagactataccctctgaaatctatgatttcagagggtatagtcatgtctccaacggcttccagtggttcagttttggcagctgggctgtgaagtaagccctgacctgttccgggggccattgttcgctggacatatgaccctccagaaaatccagcagctcctcgaggttcgtataaacgaatttcccatcggcgtagcaccatttgcagtactcctcgttgaatgcgccatccagctctttgctgatgctggtatcctccaatggcataccacagcattggcagattagctgtctgggcgaacccaataaggtattgatggaaacgtcgaacagcttggaaagcaattttagtgtttccgtgtttggcaccgtttcgccggtctcccaacgggagaccgcttgccgggtcacatggaccttttccgcaagctgatcctgagataatccgtttgtggtgcgcagtttcaaaagaatctctttggtatccatgttaatcaccgccttgcttagattgtaccatggcgggaaagaaaagcaaagcaactcgctgttgctcctccaaacgtgcaattgccgccgctgagaggtcatattccgcttgtcgaggtgactggaattgaacccgcggcatcttggtcccaaacgcttgaactaaattttttgtggtgaattgtagtgctttccggtgcttttcgctcggtatcagatattttttgacgctcttaaatccgctgtttccacatgttccagtcctgactgtggtcaaatatgggggcaaaaacgcttcctgaccaggggcggcaggtgtctgccgatcccggccgggaagcgttttttgtgtgcaagattacttgagttccagcagttgctgagcggcatctattgccgcccgcttatcccgaacctgtggatcatcatacgattttctgcggcacatccagcaggaacagtgaatcttgcccttggaaaatcgtccggcggcgccacgcgcccacgcggagataaactcttcgcctccaagttggcggaggattctctccttacgatggattgtgcgcatgcgctgtttacggtagtaactgcgatttctgttcaattgtactcactccttgacagttcgggccgcctgcaagagtcgtcaaggaaacatgctctcttacaggcaacctatctgccaagaagaaaatcggtaataccccatcattttaaccccttctgttttggctattgtacctctgccggggcagagatgcaaggtgtttttccaagtcaggcgtatcattttttaccacgcgataaacaaagaatacgcccgtgggcaaagtccgtctcgcggcagggctggcccgctggatcaagattcaaattcgggattctgccgctcggcggcgatgcgggccctcttgccggaaaaggcaaagccatatttcacaatggagcgaacccccattgccagcaattcggtgcagtaggagcggtcattgatctgctgtaacgcggcctgggccaactcctccagctgcccttccgaacagcctttccctgccttcaattcaatcaaaatccctggcaggcgctgatccagcgggagcaactggatgtcaaaccgcccctctccagactcacggttggaggtgacacggtagctgttgtccagcacggcgcacaggcccaggaccataccgtgatagaaggtctcatgggcggggtcgtagaagctgacggtctgcatgaggtatcgctccaatccccgctgcagcgcgtcaagatccatttgatagagggcctcctgaatttcaatcgcaatgcctctggggaggatcggctcaagctgggagaggatctccttgctgtagacaaaggagatctctttgttgggcagagccacttcacacatatagtcctcgccgtaagactgggcgcagcttacggctttcaggtagcccgccaccagcagaaagctgtaaacagaggaggggttcttctggatctgcggatagataacgccggtgtcaatatgggtgaggaaggatctgccctgcatcagcagctccaaccgttccatgatatccggcgtggcagcggccagcacctcacggataatttcgttgctgccggtggactgccagaatgccttggggcggcagttgttgccgaagaacccgatcaccgaccaagggttgaatatgtcggtgtttccgaagcgatagccgtcataccagtcacagagcacctgatactgttccgggacgccgtagtattccgccatttcccgcacctcatcggcggtaaagccgaaataggcgctgtaccgctcgtcaagaatggagttgatcttcagattgttcagtccgctgaagatgctctctttggcgacacgcagaatgccggtcagaaagccgtagctcagatggggattgtccttcaggccgccggagaacaggttgcgcataaagccaatgaccgtatcgtaaaacccgttcacatggccctgctggatgggcgtatcgtattcgtcgatgatgatgattggggcagttttatggtgcttgtggagcagcagcgtcagcgtccgcagggacatctgatagtccacctcatccgccgcttccgttgcgaggtgggagaattccaccttttcgtaatcgctgagggcaggactggaggagagctcgtcgtgacggcgaaattcctgggcgataagctttcgcagtgtttgatagatctcctcccaggtggggtatttcacatccttgaaggagagaaaaatgaccggatatgctccttggtgcccgcggtaggccgctccactggaccagatcttcttatctttgaaatagatggaggtgtcctcgtccgttttttcgaagaaggtgcggagcatgtccatgttcagggttttaccgaaacggcgggggcgggtaaacagggacacctttggccgctcatccaaaaagtccttgatcagcagggttttgtcaacatagtaataattgctacaggcctcccgataatcggacacgccgatgggcaagggcttgcgtgtagccagaaccggggcagaggccacagtctgccgcccccgcttgtcccggggtttttgcgtgtcgtcggggatgatccactgccgaccttccttgtgcgcaccggcgattcgcccggttttgcaaagctcattgacacgccgctctgtaatgccccaagcaagcgccgcttccttgatcgtcatacggcagcaccgacctttctgttctttaagaacagtataaccactatttcgaataaaatcaaccgcattattccgaataatagaggcagtgttcggcttttcgatgggaagcggaagagaacatgaagaacatgctgttttctgtcctttatgagcagaccatcgtggttctggtttagactgcagatggctgccggtgtgaccggcaagcagctgatagcctgtgcgtgcctcatatacctttcgttccacggcggaaaagattctgaggtaaatgattggaggtcttgattcagaatttgaaaaccagtatatgtgcgtccttttccgatgggacccgtgtagaaacggaataaaatatcctcggagttgcctttgtgtatattttccagaaaaggcttgtcgaattcttgaattccgattatactgtagaaaaaataatccaaaaccaaacagcgcatgtgagcaatatgctatctcccggcctgtgcgaaccagtcatatacctcatgcaatccggtctgctttgtcaatgtggtcgcaaccgatttacgggtatcaggaatctctgaacgcacacatttcagaacggtatatacagactatgtgaagcacgacgggagctgccccatggatgttacctggaaactggaccagccaattccgtagaagtttttaagagggtaaataaattggtagcgggataaggaggttccacagtatatgaaagataataacctaacaataagtctcaaaaacattattgtagggtaggcaattaacacctttaacatccaagaaagatatttaatgggaaaaccgttgtgacactgcgccataggtaaggaggagcctttacgatgacgggagaaaaatttacactgatgcagtacccagtaagtgcgattctgggcctgattgcggctgaggattttgttattccggaaattcagcgtccctttgtctggaaacgcagccaggtgagagacttgattgattccctgtatcagggctatcccacaggctacattatcacttggaaaaatccagacgtccgtacgaaggacggcggccggtcgaatggaaagaaagtgctgatcgacggccaacaacggatcaccgcattgatggcggccattgctgggcaggaggttctggatgaggactttaactgtgatcgcatcaaaatcgcgtttaatcctttggctacggacgacagcaaacgctttgcagtgcaggatgcctctcatctaaaggacaagaggtggattccggacatttccactatattttccgttgattttaaacagagagcatttgaaaatgaatacgccaaggaaaacccaaccgtagatttggatgagttgtctgaaacgatcagcaaactcaagggcattgccaaccgtcagatcggcgtcattgaactgaaccatacgctggatattgatgaggtgacggaaatcttcatccgtataaactccaagggtacggcgctgagtcagtctgacttcgtcatgtcaaaaatggcggcggacacggagcacggcggaaaccttatgcggaaagcagtggactatttctgccatctggctgtaaagcccgaattttatacccagctggcccatgatttagaattccagcaatcaaagtatgcttcaaaaatccagtggctggccaaagattatgaagatatctacgacccagactacggcgatatgttgcgggtgtccttcatgcatcaattccatcgagggaaactggcagacctggtgagcctgctctcaggtagggattttaagacgaaggagttccgggaagatattatcgccgactcctatcaaaaattggaccaaggcatcttgaatttcatgaaccactacaactttgaccaatttgttttagcaatcaaaggcgccggtttctgttccagcaggctgttgaactctgccatgacgatggatttcgcgtacaccctctacttgcttctcctgaatgatcccgcaatcccaaacgaccagattaagcggtatgttcagaagtggttcgtcctgtccacccttacttcccgctacattggctcgccggaatcccagatggaccgcgatatgcacagcatggaagaaaaagggttcctcgcctttctggaggaagtggaggcctctgcgctctcagatacattctggtccgttacgctgcctcagaatctggagacgtccgccgtcaatagcccggtatttaatgtgttcctggccgcacagattcgcttgaacgcaaactcacttctgatgcacggcacaaaggtgagcgacctgatcgcgatttctggggacattcaccacatctttcctcgcgcctatttgaaaaagaatggtgtggacagtaagacgaaatacaatcaggttgctaattatatttacttggatacacaagttaataaagcaatcagcgattcggcaccatgtgattacttcaaaagggccatccagcaatgtgaatccaaggtaccctcttttggaaatatcacagatatcaccgtattaaagacgaatttggaggagaactgtatccctccaacgatcgcagagatggacgcctcgagctatgacacctttttaacggagcggcggaagttaatggcggcaatgatgaaacagtactataagagtttgtaaggctgcttggatatgttgattatgaatactgcctctccaaatttgcagaacaggagggtaagctggcgggagaattttacacgccctcctgtgtggtccgcacactggtagaggtgttgcagccattcaatggccgggtctatgacccctgctgtggtagcggtggaatgtttgtgcagtctgcaaagttcgtggagaaccacggcggcaacatcaataagatttccgtctttggtcaggactccaaccctaccacctggaagatggcccagatgaatctggccatccggggaattgaggcggacctgggcaaattcaacgccgacaccttcttcaacgattgccacccccagctcaaggccgactatatcatggccaatccgccctttaacctctccggatgggggcaggagaagttgctggacgatgtgcgctggaagtacggcacgccgcccgcaggcaacgccaacttcgcatggctccagcacatgatctggcacttggccccgggtgggcgcattggcatggtgttggccaatggctccctatcctcccagtccggcggcgagggcgagatccgcaaaaacatcatcgaggacgatctggtggactgcatcgtcgccatgccgccccagctgttctacaccacccagatcccggtttctctttggttccttgccaagaacaaaaagcagaagggtaaaaccctgttcatcgacgcccggaagatgggcaccatggtaaaccgcaaactgcgggagctgacggatgaggacattcagaagatcgccgccacctacaacgcctttgtagacagcacgctggaggacgtcaagggattctgcgcggtggccaccaccgaggagatcgccaagcaggactatatcctcacgccgggccggtatgtgggcatcgaggagcaggaggacgacggggaaccttttgaggaaaagatggggcggctgacctctgagttatcggagttctttacgaagtcccacgagttggaggagcagatcaaggagcgactgggggcgatagggtatgaaatctgagtggaagaaagtacctattgaaagtttgtgtattggaatttatgatggcccccatgctactccacccaaaagtgattctggcgctgtgtttttgggcatatcaaatttctcaaatggtaggctcgatttatcaaatatccgctatatctctgaagatgatctgcctaaatggacgaaacgagttacaccaaaggcgcatgatatcgtcttttcttatgaagcaacattgaatctttatgctatcattccagaaggattttatgggtgtttaggccggagaatggctcttatacgaccagatgaaagtaaagttgattacaaatttctctactattatatgtattcttcacagtggcgagaggaaattgagcggcataaggtaaatggttcaacagtggatagaataccgttggtttcgttcccctcttttacagttaatcttccaagcacggccactcagaagtacattgcagagatattatctgtattggacgaaaaaattgaactgaacaacaagataaacgataatttagcggcttagagctggatgtcggagacatcaatttcgccggacatcagtttgggcaggagtgcatctcttgttgccgacaaccttttattctcggccttattggaatgacattgtgcgagaataggcaaggcgagagcgttaaactcatccagttcttcatcagatggaagagcaacagggtaggacatgatctgctgtttatcgccccgtggcatctttgtcccttttgatcctgcaaccatgtaggcgaagaatttatccgcatatagagtgctgaataagtaggccgcatactttagctgaacaggcgtgaaacaaagaacatcagttgagcagccgcacccgtcctcgcagtaaacaattttcttaaaataagggcgaatattggaaatcaaagtatcgcccttatgacaagcggtagtctgcgatatcgttggaaggcttgtggcctcagtcgcgccagctttccccggtagcatattctccgttgagaagtaagtgtttgcattcagttcggaaactgccactctatctctggaataagaggaaatatctgatagccttccttgctcggttgccgttctgatatcaccaaaccgctcttgatataccgtttgcaagagttcagctaaattatcgtttattatcctattaactctcaccagtggcgagagtagattttagaagaactgccactgctgtcgttctccatactgacaggaggtacgactgtgaaagagagactgattcatgatattcaacagcaaatgttgccttatctcaacaacgagcaaatgcttcgactccgggaaacattagaacattccctatacggattcaagatttgcgaggctacggaagccaagtcggataagccatacgatgccgtggcagcgtttatcacggccaagcggacggaaggctgttccgaaaagaccttgtcctattacagaaaaaccatcatgaccatgctggcggccattgacaggcccccacagcagatcgtgacggatgatctgcgccggtatctgacggattatcagaatgagcgaggctccagtaaagtgaccattgacaacatccggcgtattttgtccagtttcttttcctggttagaggatgaggactacatcgtcaaaagccctatccgtcgcatccacaaggtaaaaacggccaaagtgatcaaagatacctataccgatgaggccttagaactcatgcgggatcactgcaccaccacaagagatttggcgatcatcgatcttttgtcatcctctgggatgcgtgttggggagctggtcacattgaaccgcgaggacattaacttcactgagcgggaatgtgtggttttggggaaaggcaacaaggagcggctggtctactttgacgccaggacgaaaattcatctgcaaaactatgtggaaggccggcgggacgataaccctgcgctgtttgtctccctgcgggctccctatgtacgattgcagattggcggcgtggaaacacggctgcgggagtttggccggaaattgcatatcccgaaagtccatccacacaaatttaggcggacactggcaacaacagccatagataagggaatgcccatcgagcaagtccagcaacttttagggcatcagaagattgataccaccatgcactatgcgatggtgaagcaacaaaatgtgaagctggcacatagaaaatacatcggataggatggtgaagcgcgtggaacagtggatggaaatgcgagcagtggactttatcgaatttaatccgcggatgcgtatacagaaaggaacaatcgccacgaaggttacaatggacaagttgcaaccttttaccaagagaataccggagaccgaaaaagcggtattttctggtggctcaaaattccaaaatggtgacacaatcatggcgagaataacgccctgccttgaaaatggaaaaacagcgtttgtagatgttcttggagaagatgaaattgcatttgggtcgactgaatttattgtgatgagagcaaaagaaggcgttagtgatccacagtttatctactatctcgccatcagcccctcattccgcaatattgcgattaagtcaatggtaggatcgtccgggaggcagcgcgtccagcagagtgtacttgacgatctcgtattgaaagttccatcattggaaggacagaagaagataagctctattctctgtgcccttgaccagaaaatcgcactcaacaatgagataaacgataatttgtacgcgcaagtaaatgctatctttacggagcgattcattaacattgaatcgttccccgatgggtggaaaaaaggaagccttttggatattgccaattatcttaacggtcttgcaatgcagaggtttcgcccaaatgatgacgaagtagggcttcctgttctgaaaataaaggaactccgtcaaggctcatgtgatgccagcagcgaattatgctctctcaatattaagccagattatatcatacacgatggggatgttatattctcttggtctggcagtttgctcgttgatatttggtgcggaggaacttgtggcttaaatcagcatcttttcaaagtgtcatccgaaacctacgataaatggttatattacttgtggacagcatatcatctcgaacgatttattgctattgctactgataaggcaacgactatgggacacataaagcgcggagagcttgcaaaagccgaagtcctgattccgtccgctgaggattataaagaaattggctctctgatgaatcccatatttgatctgattgttgcaaatcggattgaagctcgcaaacttgctgaactcagagatgaattgcttccaaaactgatgtccggcgagattgatgcctccgccattcagctctaagccgctaaattatcgtttatataggaggtcgaaagatggatttaaacaaattaagacaactgattcgtacaggtgagtttcttgaagacaatataaatgatgataaagtccgcaatcaatggatatttgaaacagaatccttcgtccaagcacttgattcaaagaaagaatcccaaatttcatcagctatattccacataaaaaatgtaaattcatcaatgcatcgagactatattcgaaatctcacatactaccacagtttaatcatggggttccttaggagtctgtataatgcagacagttcggaaatgaaacctttagatgtaggctctcaaacggtttttattgtacacggccatgataattctctgattgtagatgttaaaaattgtgtggagtctatatcactaagcccggttgtcttacgagaacagcccaataacgggcagacaattatagaaaaattagaggattggcttgggaacagcaaatgtgcaattatactgtataccccttgcgatgttggtcacgcagttacagaaacggaggatgaataccgcgcaaggcagaatgtagtctatgaacacggcttatttcaggggtacttgggacggaagcggatcatcgtattgcggaagggcaacacagctttgcctggagattgcagtggcatagtctatatttccgtggataacaatcatacatggtgtgatgaactaaagaaaaatattcttgctatagacaaatgaggaggtgacctccgtgcctttcaccgaatccaattacgaaaacgcagttctaaagctattcaccgatgtgttgggctactcccatgtctacggcccggacatcgaccgggactaccacgacccgctctatgaggacctgctgctcccctccttgcaccgcatcaacccggggcttcccgcagaggcgctaaacgaggccgtctacaaaatcaagaacttcgagactggcaccctgctccagaaaaacatgaccttcacggactatatgcagaccggcgtacctgtcaaatactttgtggacggcgaggaacgctccgccctggtctatctcatcgacttccgcaacccagccaacaatgattttactgttgtcaaccagtggactatcgtggagaactcggaaaaacgcccggatgtgatcctgtttgtcaacggtctacccctggcggtggtggaactaaagtccctctcccgggaggagacggacgcctctgccgcctaccgccagttgcgcaactacatgtacgagatcccgtccctgtttatctacaatcaggtctgcgtcatgagcgacttaaccacctccaaggcgggcaccatcacctccggcgaagatcgcttcatggaatggaagaccagggacggcaactatgagaatacccagtacgcccagttcgacaccttctttgagggtatgtttgaaaaggcgcgctttctggacatcctgaaaaattttatctgtttcaatgtggatgggcaaaacaccttcaaggtactggcggcatatcaccagtatttcgcggtgaagaaggccgtcgaatccaccagacacgccaccgtgacagacggcaagggcggcgtgttctggcacacccagggcagtggaaaatccctgtccatggtcttttatgcccactacttacaggaggcgctggagagccccaccatcgtggtcatcaccgaccgcaacgacttggacaaccagctctacgggcagttctcccgctgcaaggactttttgcgtcagacgccccagcaggctgagagccggcaaaatttgaaggatctgctggcgaaccggcaggccaacggcatcatctttaccaccatgcagaagttcgaggagaccggcgagcccctgtctgagcggcgcaacattgtggtcatggcggacgaggcccaccgggggcagtacggtctgacggagaaagttgtcacaaagcagaacgacaagggcgaactggaagtccacacctccattggcaccgcccgaatcatccgggacagcctgcccaacgctacctacatcggttttaccggaacccccatctcctccaaggaccgtagcacacgggaagtgtttggtgactatatcgacatctacgacatgacccaagccgtggaggacggggccacccgtccggtctactatgagagccgggtcattcacctgaagctggatgagaacaccctgcgcctgatcgaccaagaatatgaccacatggccgagaatgcggacccctatgtcatagagaaaagtaaaaaagaactgggccagatggaggccattctgggggcggacgaaaccatcgattccctggtctgcgacattctggatcactacgagaattaccgggcggatctgctgacaggcaaagcgatgatcgtggcctactcccggcccatcgctatgaagatataccggcggattctggaactgcgccctgcttggacggagaaggtcgcggtggtcatgacccagggtaacaacgacccggaggaatggcgtcagatcattggcaacaaggcgcataaggacgatctggcccggaaattcaaggacaacgattcccccttgaaaatcgccatcgtggtggatatgtggctgaccggctttgatgtgccgtccctggccaccatgtatgtgtacaagcccatgtccgggcacaatctgatgcaggcaatcgccagggtcaaccgcgtcttccgggacaaagaaggtgggctggtggtcgattatgtggggatcgccgcggccttaaaaaaggccatgaacgactacacggtccgtgacaagcaaaactacggcgaccccgatgtagggaaggctgcctatcccaagttcctggaaaaactggaggtttgccgcgatctgttccacggctttgactatgccggttttctcaccggggacgacttggagaaagcacggaggatcagcggcggcgtcaacttcctgctggggaagtcggtggctgagcatgatctgcccgatgtcgaaaaaacgcagaccgtctatatcaaggaggctcttctgctcaagcaggccctttccctgtgtggcagcatggtggatgcgcagacccgtttcgaagcggcctattttgaggcggtgcggacgatgctcgttcgtctaacaaccgacggtgccgggaagaagttcaccttgccggaggtcaacgaacggatcaatgaactcttaaagcacagtatcaaaagcgagggtgttatcaatcttttttccaccgttgggacagagttctccctgttcgacccgaagttcctcgaagaagtcgccaatatgaaagagaagaacctggcggtcgagttgctgaaaaaactgattgcagagcaggtgtccatttatcggcgcaccaatgtggtgaaatcggaaaagttttctgagattatccagagcgccatgaatcggtatctcaacgggatgctcaccaatgaggaagtcattcaagagcttctgaaattggcaaaagaaattgctgatgccaatgcggagggggaaagtctggggctgactgccgaagaacttgctttctatgatgcactgacaaagccgcaggccatcaaggatttttatgagcatgatgagttaatcgctatcaccaaagaactgaccgatctgcttcgcaaaaaccggacaattgattggcagaaaaaagaaagcgccagagcgggtatgcggagattggtcaagcggttgctcaaaaagcacaagtatccgccggaggggatggaggatgcggtgcagaccgtaatgagccagtgcgagatgtggagcgaccaattagacatgtagattgcatttaggttctccaattgctatggttgaagcagtaagacaactactggatgcaacacttcggtcttcaaaatagcaactacggccaattgagaaaagaaaatcagcaaaaatgcgggaacgaggtttgcgatggatagcagagaatatatgcttctgattaacggccaagataagaccgactccgtcgccagcttccattttcaggacggtatgtgcgaggtggtctatgccaattccccaaaggcctatcactaccgtgctgaaaaagtacagcttctgaaggtacagagccggattgatccatcgcagttcgccattactgtggatggaaatcctctttctcaggttgatgagattctggattttagtcctttttaccgtttcatccggacaggaaaaaaagccattacatacccaaaaagccaagtggaactccagaaaaactgcctgaaggaccagaagcaggcgggcgtttttgaatacttcaaagaaacagcagcggcggtcagtctggtagccgaaggcggcctcaacatcctgagtgcccagtatgagcggatcaaaagtgtcagcgacataaccgtactgtcctgctatttggattcttccaagaaacccgcagtgcgggcactccctggggcggtcatctatccctttggtctgaaccaaagccagaaaacagcggtggagaacgccctttcctcccaggtcagcatcatccaggggcctcccggtaccggaaagacacagaccattttgaatgtcatcgccaatgcggttcggaatggtcagacggtagctgttgtttccaacaacaactccgccaccttaaatgtcgcggaaaagttggagaagaagggtctttcttttctgactgcttttctggggagccgaaccaataaggagcatttcctggagacgcagactggtcaataccctgatatgtcggcttgggttctggaggcggaagagaagtcgcacttggaccaggaggtgacgagtctctctaaagagctcagcgagatgctcaacgcaaagaaccgcattgccgccatcgagcaggaactcctgcagctgacaccggagcagcattatttcggtgagtactacagcacctatgcccaggcacccaaaaatgaggtgaaaggactctcctctcaaaaaatcttatccctgtggttagagtacgagcagcacgcccagcaggagagcaaattgggcctgctccaaaagatatccatcctttttcgctttaatcgcagtgcactgaaagtattcctccagacgcccgaactggtgatcccgtatctccagcggcaattctacgtggtgcgccgacaggagctgacggaagagcgggcccatctggagaagaagctggagcagtatgcctttgatgaaaagatggcagagttgacggaaaagtcgcttcggttattccaggcggagctgagtgaaaaattccattggcaggagccacgtcgatgctttgagatgcgggattttcgtggaaagtctggggaatttaaccgggagtatccagtgatcttaagtacgacctactccattaaaggcacactaagctttgaacatatctatgactacctgatcgtggacgaggcctcccaagtagatttagccacaggtgtactcgcctttgcaagtgctcgtaatatcgtcattgtgggagatctccagcagcttcccaatgtgctggacagcaaaaacttcccggacagcgaggcagtctgggcgcggtattctctcccggagatctaccatttctctgcccacagtctgctctcctccgccattgccacatggccggaggcccccacggttctcctgcgggaacactatcgctgccatcccaagatcatcaatttctgcaaccagaaattctacggtgggaagctcatcgtcatgacagaggaccatgaagagccggatgtcctgaccatgtatcggacagtgcctggcaaccatgcccgaggtcacctgaatcaaagacagatcgatgtgattcggcaggaggtactcccaagtctggcgagacaagggtatgggagtatcggcatcattacaccatacagagatcaggtgacggcaattcaaacacagctgggcaaggacctggaagtggctaccgtccataagttccagggccgggaaaaggacgccatcattctcacctcggtggataatgttattaccgactttgtggatgaccccagaatgctgaatgtggcggtatcccgggcggtcaaatccctgactgtcgttacctcgcaggacccacagaatgaccggactaactacggcgatctggcccgctatatcgagtacaacaactgcgcggtgatcgagagcgtggtgtactccgtttttgatctgctctaccaggggtatgccgagcagcggcgtgcttttctgaaaaagcatgtgcggatttcagaatacgattcggaaaatctcgtctatgctgtgatccagaatatgctccaaaaaacagagttttcttttgtggattgtgcggcccatgtttccctggtcaacttggtgaaagactactccatgttgacagagggggaaactgtctacgcccgtaaccccctgacccatgtggactttctcttgttccgccggatggacaaatcgcctctgctggcggtagaggtggacggtgccgcatttcatgccgcaggaagtgttcaggcggacagagatgaaaagaaaaacaggatctttgaacggtgcggtattcctctgcttcgccttcggacagatgggagcggggaaaaggaacgaattgagcagggactgcgaatggcactggaattgggtggttgacaaatgttccgtaaagataggcggtgctcagtgatgaaaatgactcgacttcgtctcttttccaataacatgagttacggtccgtggccggagccgggagcagaggtgaagcagcaccttaccatcacggcggacggacggaccgttttctctacctacggttgggaggggccgccagatcaataccggaaactcggccgccgaatcttccatgtcgacccagctaaagcaaagaagatattggaagcggtggtcgcccggtttaacaatggacaagacgaactgtttgccaccgatgtgggtacctgggaactggaactcaccaatcgtgagggagaatgttatagatttcggggttccctttgcgcggagccgagcacagatttcgctatcctctctgacctgatccgggacaccctggggatgagaaaccttttcgcctttgacggcaacccggaccgggtgacggtggactaccaccgttttaccagaaccgataccaaagccccagactcaggcgaaaccatatatcagaactggcattgcacagagcagttagtggtagaccgggccagcagcaccgtggaacttgtccaaagaacggctcctggctgtgtattttctcaaaaactgcaatcagaggatgtagttgatccgctggacgacttggaccctaacagtttatttggagtgattgaaggaaacccagaggacgcagtggatgaccccatgaatactcgtgactataccatcaccgtggacttcaggcaccggccgcagtgtatcctccaaggaagctatgataaaaaggccctgccggaggactggggagactttgctgatgccttgtggtggctcctgcaatctcacggaaggggagaactgttggatcccaccgtctatggaaggatcaagcgccgcacttcggatctgatgtattgcggcgtggaatttgagggggggcggcaagcgataccactacatctctgacgatgaggagattgcggtgggcgattatgtcctggttccggtagggaacgataaccaccactcggcggcgcgagtggcggaaacggggttttacccggagaatcaggtgcctttccccatagaagaaaccaagcatatcatcgaaagacttccgagaatagagaatacctcgaagttgaaaacggtgaaagatgatccggaaacggatattgtagaggcccatttacattcgtaccgcaaccggcgtgcgttagagcaagccgatgtgtgcggttgctttcattgcctgaagattttctctccgaaagagattgcggagtatgtggatgatcatcagaccgcaatctgcccctactgcgcagttgatgcagttattggagagaattctggttttcccgttacccaggattttctgttgcgcatgaggagaaagtagtttgatagcggttcgggcatggagttggttacaccctttggtcggattcaggtcaaactggacgggagaccgatttgcttttcttatgaggcccatgaaccaattgaggggatcttccctgatgtggacggaatatatcgaatcggggtggaagtgcaacaggatgggagaaaccactcgttaaaattggagttgtcaagtgatggtacatcgggtgaacctgaaccgggcgaaatgttggaagcgctgtcattttaccgcaatggtgggaagatcaccttgggatgttatgccgcctttggggagatgaatgcttatgggcttgactttgacggccagtgggacgatagcggaattgaggttctgattttcccattcacaaagacgcatacctaccagtttggtgtctgctggctcaacacatgtacagaagaaacagatgttcagacctggtatggtgcagatccatccatctgaggcatacaactacgggatacctggacagaatatggaaggagcagtatttctgtgatcgtcatctgctttggtgactccaacacctatggctatgacccgagaggctatttcggtggacgctatgacgcggacagccggtgggtggacatcctggccgcggagactggatggatagtccataacatggggcagaatggccgggagatcccggcggtggcccctgtgttccctgctgacaccgatctgttgattgtcatgccgggcaccaacgatctgctccaaggaaaaagtccggagcaggctatcgagagtctggaacgatttcttttcagcatcgctctggattggagcaaaatcatgcttattgccccgccgcccatggctcagggagagtgggtacccagtcagcaactcgttgacgattcacacacctttgtagggctctgtcaagctgcggcagagcgaatgggcatccgctttgccgacgccgggaagtggaacatctccttggcctatgacggcgtacatttcacggagcaggggcacagagcctttgccgccggacttttggaggaactgaaatgaaacgaatcgcaccattgattttctctctgctgttgctactgactggatgcggtgggagcgccgatgacgcttcctaccagcagattactcaggaaaaggccaaagagataatggatacccaggaggtcatcattctggatgtgcgggagcaggacgaatatgacagcggccacatccccggtgccgtgctactaccggtgggtacgattgatgaagaaaccgctgccgaggtgattcccgagaaggattccatggtgctggtctactgccgcagcggaaacagaagcaagacagcctccgaaactctggtgggcttgggctacaccaacatctatgaattcggcggcatcaacacttggccctatgaaacagaatcatgatgacaacagaaagtctgtaagcagtacagaatttgcatcgccgaaacaaagaatacgagactggccaagttggtcagtcccgccgcttatttgggaagatattcttcccgcacccgataccggctgatgccgaagctgctgccccgctcgatgacctcctgggggagttggttcagatattttcggccaaagttggtgttgccgaagtagcagtcaaaattggtcacagggagcaccacccagttgctgtcctccgaacggttggccaggtaataggccaccaaggtgggcaggacattggaaggcattttctcagggcgggcctgctcaagccgtgctaccagttcctccggcagttccagctccgtgcggcgcagaggacccaactccagggcgtcagcgatcacatcgtcaaaacggatggtccacgccccttctgtcagggtggagaggctttttgtctggtactgaagcactttgctgcgccactcctggttaaacaacttgtccagcctcccggcggaatcagcgtagttcttatggaccaggtccgggtgctccaaagcaaactgcatcgcccggtggaagtggccgctgaaccaaccccagccctccttattcaccagtttgggaaactggtcgtgaagcggcgcaaaatcggtgcggtgctgccactcctctttggggttgctgtcccgctctggaatgctgcaccaagcgcacaaaccattgcgagcataatcaacccgccccctgggatcgccgaacaacagtgtgccgtccgaagcgtgaaacaggaagccccgcgccaggatggtcaaaatgcggttcatgccgctgaaatcccgcagggcctcgaaggtaaaccgccccagccaggtggtatcctttttgctggaggcccgatactccaccggctccgtataatctaaaaactcctgccactcattcagcatggcgtacctccagaatattgggctccagcgcgtccagcagcagatcccacagcaggttccgcttgcccagggcctccacatagcgcacagccgtctgcggacgcacgatctcattcagcagttcccggcaccgggcggatacagcctccttgtagtgctgggaattccgcttgctgagatatgcttccatcaagtcatcaaataccggcgagtctcccggccggtgcagctgccgcttcttctgctgttcattctcctggagaatgtcacagagcagatcgctcaggacccggtatccgccgctgcggaagtcggaaaacaggtcaaacagatcctcgaactccggcagccaggtgaaaaggaactgcgttctctgctcttctgttagaaactgccacttggtatcctccagcgccgcccagatctccgtcacctgttccggaggcagttgtccaaattgggcgtacagctcgtccgtgtcccacaactcctcctgccctcgggcaaagaggatgcgctcgatatcgctcttccgcttcttttccttaggcgccacccgacaggcccggatgcgggacagacaggcttcatagtcagccagcaacgcggaaatccgcttcaaaatctcccggtcaagatgatccttccaatccggctcctgggcaaaggtgaagagttcgcagtcctttgccggcttggatttgagggccggtgtgtatttttccagttggagtgccagatagggcatccgctccagattggagtccaccttgtcccagtcgattttcttaaaaaaggccttgatgcgctgctggtgggtctgctcataccaggctcgccgtgtctcctccgattcctccaccagatttttatactgcaggaagggcgtccgctccacccggcgctccttcaggtactcgtccaggtccggacggatgccgctcttggccgagtcgatctccagcccagtcagaatggccagcacctccgtctcctcccggagacgcctgcgctccgccgcgtcggagttttcattgtaggcgatgatgctgcggtccagagcggcgttgcagatctgtcccacccgggaggagaaggtgccccgcaccacctcaaaccgtgcctgccagtcatccgcattgcggatcagcggttctgccgatgggatcatcagcaacgggatgtttgcctcattggagagttcgtcatctgcaccgttctgggacgcctcatagttccggcggacgcactcgttcaaaatgggatcggcaatggtcttgatcatatccccgtcatagtccgcaccgcccaggcgctccgccgccagcatggtggagtccaccatgacaaggtcggtgagatggcggaagtagtagtgccgcatctgcagcttttccttcttggcatcgtagaaggagagctgcagttcttcatttctggcgatatgggggttgcgcagcagagtacaggcatctccatgctcataggctgcgccgggtgcgtagaaggcgctggttttgaaccggaaactcttggtcacctcgtaatatgccttgttccgcttcttcttcggcaccgactccagcagaaaactgataaagtccatcaggtcgccggagagatagcggttgtccccggccacgatcagccgccccacggcgtagtccttcaagatctgctttgctttgttgtcaagctcccgctgataaatgggctccccgatcatgcggggattcttgcgcaggatctcgcccagcagatgctcccggcttttgcggaagggcaggatgccccagcggtccatccgtttcaggaagtactcctgctggaacgcccggttggcccggaagttgtagtaggccgcctcggtctgcttggtgagccagtttctcttatcctcttccggactgtgatcccagccatcagggagatcccgggggcggaactcctcctcccgaatggagacagtattcaaaaactggtagttcagctcggtatgggtctccggcttcaccctgctcacattggtgatgtacaaagcatggcggtagcgccggaaggtgtcccagtagtcctcccaggtcattccgctgtccctcaaccagctaaagcccttgaacatgctcttggtgaggataatgtccacatccttgacgcggtgttcatggccccagatgtcccgaatcacctcttgaccgcacaagcctaaaatctcctggaagtccacctgatgcaccatgcccttgatgtagggcagacggatctggaaagaggtgtggacggtgccaccgcagagcgcccgatcaacgatcttggcatactgcttggaaatgagtccctccccgtcaaagcaggtgatgggaacatccatccgccgctccacccggtgatacttccgggtgctgttctgagtgccgtcatcctccacggtaataaccggaacatctctggccgtcaccaccggattgtccaccacgatgacgcggtggggtttgtcaacgccgatcccgtccagccgcacgccgctggagagcatcaggccgttgtaggcgtagagcttgctgagctgacagtcgccgatggtcatatccatctggatgcggcggcgcacctgctggtacacatccttccggagaaaagagagtttactctgacggttcatgcttcccgaacgctcgaaggccagatagcggcgcggcccagcacccaggtccaggcacacgccctccggacgaaacatgtcccgggccttctcctggcggatctgctggcggggcagcgtactgctgcggtcaaagatcccggagaaatccatgtagaagatcacatcagacaggccgtcaatgagccggtcgttggtaggctcggaaaaatcgtctccctgcagaacgcacatgacctggaagaacagtgcgttgccgtcctgctcgtgcagggcggaaaagcgtttgcacttttccgcagccgcccggtcaagggcaaaatgccaccgcccgttttcctgagtggcatagctcatcaccgcccgggcggacagttcaaaaatacggtatttgctctgggccatgttctcacctccggataaccctattctatcacagagaagcaaaaaagcaacatagacactgctcccacaaattctgcgggaacttgttactctgtgatgaagaaggaggataaaaaccaatgaaagtctcgaacattctatcctacgacgatctgccgctgtttctcaacgcgaatctggtggcacaggtgctgggcgtgtccatctccaccgcctacgaggtgatgcacgaacccggtttcccgacactccgtgtgggcagccgcatggtggtaccgaaagaaaagttcattcagtgggcggaagaacagtccggaggtgcgaaatgagaaagcagagctggaccaagcgggatcccatcaaaaactatttcccactgcccaacgagatctacgatctggggctgtcccgcggcgcgatttcggtgtacagtttcctgctttgccgggaggaccgcaagacctatcagtgtctgctcagctaccgggagatcggcgagggcgtgggcatgtgcgtgaccacggtacgcaagtatgtggcggagctggaggagcggttactcattcgcaccgagcgcacgactgttaccacaaaagacggccgcaagcgcaacggccgtctgctctatcatatcctgcctatccagttggccatcgatcagtactatgagcggcagatggacatggccgacctggcactggaacagcacaaggcaaagcagcgcctggccgcgctggagagaaaggagtgtgcatccggatgctgatgcaggaactgggtcgtatgatccgggaagatccaaacctgtgcgccatggctatggtggacaagcgaaagtacatcatcagcaagtggaacaccagtcatagtgagcccatagacgaagatgccgtggcactgttcctctgcgatgagaaccacggcaacctcacggatgagcagagggcatttgcgaaagagcgctgtgcggaattcgacttctgcaatcaaattactgtggaccgtctgtttcaatgcggcgagatgatgcgccagcatctggtgtccggcccagcggaatactgccgaatcttcctgccgcagtgcaccgtcccccgcgacaggggaatccccctttgcagcggcctgtgaagcgctgtgtgccctctttgggacagagcagagtccctgccccactgggggctttcaaggcggatttggcccgatttcgggggacgctttgggacagggcaaaatggggcccccggcgaagcccagcggagcgggttcgctggggagaggcggagcagcggaatgagcgagttttcgccactacggggcggaaacgagggattggagcttgcgacgacgaggagcaggataaaagccggggtcgccaacggcgctcccggccagtcacaccgccccgcagtgcggggcggggcaacggtttgcgggaatttccgtaggtggtcggaaatggggtcaaaatcggaagggtgacatcacttttgcggtcaacatccccgaaagcctactgccacaacgaaaaagtcggggtcacgccccggaaaggagtattttatgagcggaaaagagaaattcgccttctatctctcaccggagaaaaaggctgtcttggagcgccggtatcaggaggatgggagtcggagcatgaccgccttcattgagcgggcggtggacttttatttggactacctcagcgccaacagcgccggactgtttctccccgcctccatcaagtcatacctggacgggcggctggggcaactggaggaccggctggccaacctcaccttccggcaggcggtggagcaggacatggtggccggcatcctggccgatgcctatcagttcagcgtggaagacctgcgccgccggcgggcggagagcatccagaacgtgaagaaaaccaacggccgcatctcgctggagcagcgggtgcggggtgtctgggaggcggacgatgagtggcaagattgattgtgaaaagcccttatctcaagtgcagcggtaaccattctgtcagcggctacctgcgatacatcgggaccagagagcgggtggagatccttccggatgaccgtccgcccaccagaaagcaggagcaattggtcagaaaactgacaaaagatttcccggaaaccgagaaactggatgagtacttggactatgcagatacaccgaccaaggcaaacgcctctgcgttcatcaccagagcattggaagaaaactggccggtggtgcagcagtcagacggctacatgaagtacattgccacccggcccagggcagaacggctgggcgaccacggactatttggtgatgaggacggtgtggacttggagaaagccatgggggagctggaccactacgccgggaatgtgtggacccacatcatctccctaaagcgagaggatgccgcccgtcttggctacgacagtgcaaaggcgtggatgaatctgctccggtccaaccgcaacgacatcgccgccgcgatgaatattgctccgggaaatttccgctggtatgccgccttccacgacgagagggagcacccccatgtccacatgatggcgtggtcaacggtgcccggtgaggcgtatctcacgcgggacggcatcctcaatatcaaatccatgctcaccaatcagatcttcaaacaggagatgctccacacctacgaacagaaatcacagtcgcgggacgagctggtgcgggagactcgccgcgcgattcggcagctcacccaggagatgacacaaagcatctgtgcggctcccgagatcgagcagaagatggagcagctggccggacagctgaaaacgatcaaggacaaaaagtcctacggatacctccccaagtccgtgaagaaaaccgtggatgaggtagtggacaaactggaggagctgccggtggttcgggagcgctacaaccagtggtgcaggctccagggcgaggtggagagttactaccacgacaaacccagagaacggaaaaagctgtcccaggagaaagagtttcggcagatcaagaacgctgtcatccaggaggtggagcgcatacggttgggtgagatctccttcgaggacgataatctggccgagcatgatgaaccagaatcggtgaaggatgagtcctacgcctgctgggaactgcggcaggtcatccgagatgagagtctccctctggcagaccgggacgaggcggcagaggaattagaacgctttgctgaacgaggtgatgtccgtgctcagtacctaatgggcaagctctaccgggacggtcctctgctaatcccgaattgtcaaaaggcaaagtactggcttaaccaggcggcaaagcagggcttgctggaggcacagtacgctctgggcaagctactcctctccgacgactgggaggtgcaggacccggacgagggtatccggtggctgaaaaaagcggcgcaaaatgggagccaccatgccgcctaccggctgggaaaactgtatttgcggggggaagttgtccccgaagatgtgcccagggcagtggaatatctgaccacttctgcggaggcaggcaaccagtacgctcagtatgtgcttgggaaaatatacctggcgggacaggaagtcccgcaggaccgtgggacggcttggacgtggttctgcgagtcagcgtcccgggggaacaaatatgcgcagttctttttggatcacttcaacgccgctcataggcccaatgtgttcctgtcggccacccgactgctccaccatctggggcagctcttccagcaaaattctataccgcctaccgcgccggtgggccaccaagtggaccggaaactgcggcggaagattcaggaaaagaaaatcgccctgggccacaagccggatgaccatgaggtggagcaaaatcagggcggcatgaccatgggcggaatgtgatccgctcaaaaattgcggggctgaaaacaataaaagtcttcggagtcgaagaacaaaatgaaatctgatggcgaaaccgaccgtctaaatgataacaatttgataatagttcgccgcagccctggctatttcctgtttttgtggtatgttgtgttgctggataggaggtgtatcaccatggcaaagcgcaggccgtccggggacggtatggtccggaggaaagaagatggccgctgggagggccgcatcgtagtgggccataaggccaacggcgatcccattttccggtatgtctacggcagaacgcaaaaggaactgatggccaagctccaccagagcatcgaaacctatcaggatgtggaactgaccgaggacagcaggatcactctgggcgaatggctggaccgatggctggacgaatacaaggcagggacgatccgccccagcaccatgtacggctaccggcagtatgccagactctacatcaaacccgtcctgggagataaggtgatctcccgcatcacctcgacggacatccagcggatgtacaccaaactgaaacaggaggggcgcatccatgagcatccggaatacgggtatcaactctcggatgctatgctctcccgtatccacgccatgctccaccaagcgatgaaagacgcggtgggcgcacacctgatcgccaagaatcccaccgagggcacagtggtccctaagcccaactatcgtccaaagcaaatcttgaacgaggcgcagttggacactttcatggccgcaatcgaacaggatgaagtgtggcgggacttcttcttcactgaactgactactggcctgcgccggggtgagatctgcggccttcgatgggaggacttcgacgaggaagctggaatcctcaaagtcaaccgctccgtcagcacccgcaaggcaggcagcctggaggtcggagaaaccaaaaccaacaagggccgccggaccatctccctgccggacagcacagtccagcgtctgcgggagcggaagaaagccgccatcagtgattggatattccccaatcccctgcacccggaggagccggtcaatcccggttatgcctacaatcggatgaaaacgatcctgaaaaatactggcctgcccagcatcaggttccatgatttaaggcataccttcgccacccacgctctcgccggaggcgtggatgccaagacactgtccggcatcctgggccacaccaacgccagtttcaccctggacacctacacccatgtaaccggcgatatgcagaaacaggcggcgaatatcgtgggtgacttcatgacagaactgttgggagaggagtggaaaccatggcaagaaagcgaaagaacggcgagggaaccgtccgcctgagaaaagacggccgctgggaggggcaagtggtcatcggctacgatgaaaaggaccttcccaaaactaagaatgtcctggccaagacaaaaggcgaatgtatagagaaattgaagcagttgcaggagcagtacgctccacccaagtcggacaagatcaagcccgaaatgcccttcggcgagtggatggacttctggtatcagaactattccaagccgaggcttcggcccactacccaggcaggttatgagtgcagaatctatcagcacatcatccctgaactgggtgatatccctctgaatcaactgacacagaacgacctgcagcagttctatgcccgactgaaaaagggtgggcggctcctccatgcagagcactacggagcggggctatccgacagcatggtgcgggccagccacatgaactgccggtccgctttggagaaggcagtgcaggaagggctgatccgtgtaaatcccgccgtcggctgcaagctaccgcccaagaaagcccgcgagatgcaggtgctgactcgtgaggagatccagcggtttctgatccaagcaaaggcggaggggtacttcgaactgttcctgctggagttgaccaccggtctgcgtcggggcgaactgctggccctccagtgggatgacctcaacctcgaaacaggagaactgcagatcaccaagcaggtctaccggacaaaggaaaatggcttgctgatctcccagcccaagacaaagtcctccatccgcacggtcagtctgccccaaccgcttctggctatcctgaaagagtacaaggagggcgtaaattcccagtggatgttcccctctccactcaaggaggactcaccgctggacccagcttacatcagaacacggctgcacctcattctggaacatgcccaatgcaagcaaatcagatttcatgatttgcggcacacatttgcaactatggccctgggtagcgggatggatgtgaaaacactctcctcgatgcttggtcatgtgtcggcggccaccacgctggacatctacacccacatcaccaatcccatgcggtccgaggcagcggccaaaattgaccagaaaatagggaaagcggctccacaggaattacctgcggagccgcaagagaaacggacgatgaccacattccaaccctatgtcggaaggaaacggaagcccggcaccggatgtatcacccagatcagcgagaattgctgggagggccgctactcccccaagtggccggacggcaagaagcactcccgcaatgtgtacgccaagacgagggaggagtgtgaggcgcttctcccgggtctgattcagcagatgaaagcggagatcagggccgtcaaggagagcggaaacctggatgctatcccggacgggatcagcgagaagaagaaagccattgccgcctatatgcgggagcatccggaaatcaccagcaaaagaactatcgctaaagcggtgcaggtagataaaaacacggtgaaacggtattacgatgagattcggagggagatggggctaaaataaattcagaaattgcgccgcttaaaacaaagtaaaagccctctggatttcattccagagggcttttgagagaaataaaatcgatattgacttttgctgatttttgaaatgtggttttagttattgtttcaaattttctttggctttctttaagtcatacttgtcgatggaaatcatttttactgcagggaggcagtaattcgaatagtagacaatcatgttggagagaaggccggctttgcaattaatggcctctttttttaattcaagatcgctggtggaattgtttaaccattttttcataatacttcttggaagttggaataagtatacttgatttcccgtgtgcaattcccaaggacgagacacctcgtgccagtgtaatgtatatgagtcagaaaagatattttcgttcccggaaactcgatacaaaaatagcagttgtcctgaatttgttattgcgacagccatgcgacgcccaatatcgctcgcgaattcaatgacttgttcctcatgtatttggcccagatgcatttgacgttttcctacttcgctaaagtaaacattatgatagccaagcaattcgcaaaagtcagtccaaaaaggcatcttattaaactccaataaaggaatacggtgcgacgctgcaaactcctgtgcttgaatggtaaagcctgtaaacgctgctattgcaacttgataagtataacgttcataatcatagagaatgttccgccgattctgtcttcttcgtataagtaatctatttacgtctacaatatcaaaatgattaatatcttctcgcaatcccagtgcacttcgaattgtatccagtccaatttttctctgggaatctttgcattcaatcaacaatcttgtccgagaataaaaaggtgtttgaactggtggttccaataatacatcagcattatgggcttctcccaatccctgaatcatttgacctggagtaccatcaaaaacatacaatccatcggatttaacatcggaaaaaccaatattgataagaatatattttataagtaattcaaatgctttccccgctttcatacatcctcctccgaagtcagtaacattaaaataaaagcgtagtaagtccccttattgaatttcacccatccgtattattatgcgatgtccattattaaatattttctcaatgcagtctctccatctttcgctaatatcactccactgatgccagttttcagagataaagctataggcccggagaggcttatctgaaaatgttacaggataatttaatacatcttctatacacttatctaaaaccaccaaatgactattatcattgagtgccaacataatcggttcattaaaaatttctgcacccgctgtcccataatctccatcatgaataacatagacatcaatatccatagatttaaaatatttgattaatgggataatagcggcttttcctcgtgcccgaacaatatgccaatcagactttataacagatctaattcctggaaataaaaatggtaatgtttcgtttattacaatttgctctgtatcaccttctacaattaaaacttttttgacaaagaaactcttagaaatagcatcatcgacccgaagcaacatttttacataagatttgttatcatcttgtagctttttaaattcttctgtcacattaaagggcttaatcttaatcgtttcaccttcgtgcccgttttgattcgtaaatacaattgacaaatgattgagaatttgatgaggcatgcggctaatgtcaatcatataaggtgaatgggtcgtacagacgatttggttgtttggattttcggccaaacgatagattgtttccctgattttgttcgttgcattagggtgcaagtataattccggctcctcaaaaccaataataagtggcctggaatcatcttcgcatcgtcttgcatccctcatgcttttataccgaagtagtgcaaatactgcagaccttatcattcctgttccttgcagtgaggcagaggttgcaacattactactcatctgtattgcaaatgatggcttaattgttgtgtcgggattgcttagatttgtatgtgctaaaatacttgcggaagggaacacatccgaaacaacatcattgagttcagacatcatttttgacacttctgtatctggattgcaagggtccaactcgtcctgtaacaagtttaaatagtgttgggcttgtcggtaatgttctgaactatcacgaacctcgcggaataattcttccaatgttttttgtagtgttccagttccagccgttatttcttcttggcgatcctgtgctggaatcaaaaggaaagatggtaatttgctcaatacattttgaggaatacctcctggattttcaaaccaatctatttgagtttcatcataggaatacaaagattcaatttcagcaagtattttttatcagcttgttttaatggctgtttgtggggtatggcctttaatttctctggtatgtcatctgggtttagtccatttattaaatagtcctctattgtcttacagtcagcaaattcttcttttagtattttattgaactgtcggacttctatcttgggagaggtaccgttcaattgaaaagtctttctatagataaagcttaatcctgaatcgttgtcatgtagaggagtataagggataattcttcccttaaatcctcgccacgataatgcagactctggcaggttcctaaattcagctgtcaaaacaatttcatgtacgatgtgtatcgaggtaccagtttcatctgcaactgcttagaactcctcctctggcactttagtttttagattcaggagatagtcaagggcaacaagcacgctactttttccaacattgttctccccgattaaaaatgttgaatcagaaaatgtaattgttgtatcaagatgttttcttaatccctgaatacgaagagaatacaaatgcatgcttatccctcgcttttaatttttcgatgaaagattttgctttttaacagtattatatcaaatagtctattacaaaggtagcctcaatcggcaaataattcaaatatgtggcaatatagttgattttctgaatagtaaggtgatgtcattccacgaaaattggggaacgactttttggaaaataatgatttctataaaggaaaagtagaagtattgaacagtccaaatcaaccgctcaatacttctactcatttccatctgtaaaatattccggtctttccagtagctatttccctctttctgtgatattgttcgtttgccaaaaggaggcgacgatatgcagaaaggaaacagctgcacagtaggccaatggtgcgaccactggttccatgagaatcaaagcaaatggaacggcagcaccgtgggcggataccgtaacctgatctaccgccacattctccctgaaatcgggagtatctcactgacagaagtgtccgaagacaccattaccagcttctatgatagcctgcggagccagggcctcagcgccagaagtgtctggtgcgtccatctgctcctgcggcgatgcatggatgaagcagctcgtgaccaactcatccctcataatccggtgcggctctgccagaaaccgaaggcaaaggaatataagactcctcccttgcgcctggggcagatccagcggtacctgaacgcagcagagaaacttggcgcactccctctcatctatacaggactgtccagcggcttgcggcaatgtgaacttatcaccttgtcgtgggccgattttcatatccgctgccggtatatcctcaagggacggcggctgctgacgctcaacagtaaggcggaacatcttctggaacggatacccgaaaccggctgccatgtattcctcaaccccaagaccggagcaccgtatcatctccacgagttctactacctgcacaagcggattctgaaacaagcagggcttccgtgggtggcctttcgaaatctgcaacgacagtgcatggaggtggggatatgaaactgaaagactatgtcctccgctggcaggaggtctatgacaaaaaccagagccgcccgaccacatatgcagctcatggttatatcttcaaaaaccacattctccccggattggggaatataccactctctgaattgacggtggagcaagtgggagatttcctggaggaacgaaagcgcttcggcggtcaccgcccggaaagccctgaatacccagggctgggcgaacataccatgcggcacatccaccggctgctccagcaatgtctggaccaagcgatgcaggaaggcctgatcgcggaaaatcctgcccgtgcgtatcactatccaaagcccaagaaggtcaacgccaatgtgctgacaccagcagaagtggaggactatctggacgcagcggagcggttgggccacctccccatgttcctgctggcgctgacggtagggcttcggcaaggagagctgattgccctgaagtggagcgacctggatgtaaaggagcggacactgactattaccgagaaacgctcggtggagcggcgggagctggtggaatacggagacgataccagaaccgtcagcctgacggaggaagtcgtagagctcctgcacttggaacacgccaggcatcccagcagtccgcttatgttcatgcacccggccacgcagaagccctactcgccgcagatggtgcgccggctgcacaatgcgatcatccgggaagctggactggatcacatccgatttgcagaccttcgtcacacctgcgccgtcctttcgctgcggaatggaatgagtgcaaaagaggtagcgcagatgctgggccacttcagaaccacgatgacacggcagaactacgcaccatacctggcccatacagccgccaaaagtgaaaacaggcccaatgaagcaaccacggaagctctccggcaagcggcaaacattctggacaatcttctgaagttctgatggctattcccaagaaggtgtggtatatgtttgtgtcacaaggaggcgatgaccatggaaaagaaactgctcaaggggttgtatgattgcttctatgccccaccggagctttccgaacaggaggaagaagtgacagcgtgccataaagcgttgatcgaggtgctggcaaagccggaacgcaagctggtgctgcggatcattgacgcccaggatcatatcaaggaagaaacctctctcgacagcttcatcgccgggtttgaactggcgtggaagctctcaatagaactgcacaatgatgagaatgagcgctcagcctcctgccgaaccaggagagtgggcgctcgtttcgcatctgaggaggaaccggaatgaaaaaacaaattgccatagccgcagcaattaccgccagtttcgccctgtgggccgctgtgtggccacaaactacggtggacacggaaatacccgcaccaagccaaacccccgcagtaactgcgcctcaggcgacgcttccggagccaacagaaccagcgacgctactgacaacagagacggaagaagtagatggaacgatagccgagcctatcttggaggaagccgatgaacagccgcctgcgcccactccagcgcctacgtcagaaaatcaggctgagtcagcgccagagccgcccgccccacttggaccagagacagagaccagcggtgataattcagcggatatggtctatgtaccctgcttcggctggatagaaagccagggccccaaccaagcaatatacgccgaggatatgtacgagaacggaaataaaatcggtatcatgggctgacgcaataagtgcgccgcataaacaaagaaatagcagcattgaaaaatcggtgataattataaataaaaagagagtagcgtgcagccatcctgaacaccaaggataccattgcgggttaaaccgctctcgcaatctttacaagaaaatatagaaaatatatgccgaaaaaaccaggcctgagaaagaattatttaaattaaagactttaataaaatacaatatttgaaaaatataaaaaatatatgtagaatgtattgacgtattttcgattgctctgtataatgaagtcaaaataaatcgaaggagcggttgttatggaaaaaaagcccgaatccaagcgcgaaagatttgtccggttggcagaagccagaactaacaaaatcatcgatatgattcaattgctggggaactgcgcaaacgccaatacctatgagtatactcagcaggatgtcgatcagattttctctgccatcgaagccgaacttcgcgaagcaaagaaaaaataccagaaggtcgaaagcaacaaaacatccaagttcaccttaaaataaggagggtgttattgaatggctctattctctcttcgcagatacgcttggaattttccttctaataaccatggtcaaatctttggcatcgctgattcaggtgttgaaacctttaatggcacccccatcaaatccctggcgcgtgagatttgccagaattccatcgatgcaaatttgaagaacggtgaacccactcatattgtttttcattcatttgagattgcgccatctgtgattcccggctttgatgacttggaagatgcgttttccaggtcgttggaatactggtctaagcagaaatctacaaaagcgaaaagctttttccagtctgctcttaaattggcaaaacaatctaagatcacctgtttaagaatcaacgatactaataccacagggctgcttggctctgatgaggaatacaattcaccttggtgcaatcttaccaagtctcagggcgcttctgacaagagcggttctcatggaggctcttttggtattggtaaatttgctccttatgcctgttccacttttagaactgttttctacagtactttggatagtgaaggggttactgcgtaccagggtgtggctcgtctcaccagctttaaggacaagaacggtgaaactacgcaggggataggattttacggagcagataaaaacgctcccgtgaagcagcaaatatccatcgacccatcctacaaccgcgaggcaggaaagagcggcacagacatctttgttttaggcttcaatggcagcaaggattggaaacacgacatggtagcatctgttcttgacggctttttatatgctgtgtatactggggaacttattgttgaggttgaagatatcgttatcaggaaggaaaccctgccagaactggttgcatcccacaaagcatatttttctgaatatgccgacgaatactatcaggtgcttactgccgacgagcaaaaatcacctacatatacaacagatatcggtacaatgggcaaggtaacacttcgactcatgatacagcctgattttcacagaagggtggcgatggttcgccgcacaggtatgaaaattactgataagggaaatatcaacggacttattccatttgccggggtgttatacattgaaggcgacaagctcaacgaatatctcagaactctggagaatcctcagcatacaaaatgggaaattgagcgtgcagaaaatagatctgaggctaaaggcgtcctgtctgcgcttaccaagtttatcaaagcctgcctgaatgagctgaaaaatgatgacagcgaagaagcactcgacccttctgttggcgagtatctcgccgctgaacaagatcctacacaaccgaaatccgaaaataaaggcgaaaatatcaatgacaccatacaagggattgaaacaaagactgtgtcccgcagccccaagtcgggcggcatgagtcaggatggcacaggcactactgaggtcgatgatcccaatggggatattatcgtggatgatatccccggtgaaggcagtcgccaaggaaactctaccggaggcagtggcggagacggcggtgaaagcggcgaaggcggagggaagggcgacaagcctactgaacaccgcaagagtttgaccaccgtatctgcagtaaagtcacgcgttatgtgtacaaataagagcctgggtgagtataccgtcacttttgtcccaaatacatccgcaacagacggtattatcagtcttttcatgtctgcggaatcccagaactacgatgcaacacttatttctgcaaccacagatggtactgaactggcagtgagcggaaataaaatcagcggattaacctttactgaaaatgttcctataaaactgtctgtaaagattgattttcatgactactgttcgatggaggtaaaggcatatggaaataaggtataaactgtatccttaccctgtcttggcatattattctgatgactacaaagacggtagttttgacactactattgatttgcagaaagatggctataacatccgcattgactttatggcctctctcaccaatgaggggatgaaaaagctgattcaggatggacgggctcagtatgtatatcacttggaatgcgctcagacttgtttccgtgaagtggtgactactgcaaatgtggcggaaagttgtgtgctttctgacaagaaaatatgcggcaagctgcagatatgtccttttattgttgcgactcaagatattactgggtatagtaatccgggatttcatgatgactataatggagcgacctttgagattgaggcaggctgtgtcttggcggttggaaaacaggtcaatgcgactatcactaaagaaatagaggatttggcgaatactccgtctgttttcagcatcattcgcaacgcagatccattagtaacacatatgctcgttggcattgatggtcagaaaatcgttgttaaactaccgctgaacgactactacagttataagcagcttgctaaggctcctatcacgcaacctattttgaacgccattacaattattccggctcttacatatgcgctggaggaattaaaatgcagaagtatcgaggaacgagaggagttgtccgagtacggctggtatagaactgtgcgcaaagctctgctgacaaaattcgatgttgatattgaaaaccctgattttaaccagcagaatatggtagtactggcacaacgattgattaatgatccacttgctgaagcgttcaaggttctctgcgaaggctttggaacaacgggaggggatgacgaatgaatctgcaatttataagctgggatgatctaaacgctataaaagaaaacttagatcagtatgtcagtaagtttgctctgccctccaatgcatggattgaagaggaattggggcactctccgttcctcaataccaaatatccgatgccggagattcatatggatatgtcccagccggtcgacaaagcatatttgacggatgcagccaatgctcaggaagtttacggcaaactgagtttcatttctgactcacaggcatcagatgaacgcttatgggcaggtatgtgtttaggtccattttatgagtacacacagtatcgatggaaaatagcgaaaaaatgtaccaaacaggatattaaagcgcactattttttcgggttcggtgctcggcgttcgctgagcagaaacgcccttgcccgcctatggtggattggcaggctaacttatgatgactcgcgtcccgatccgtatgaacttacaaagtttgtatgtgaaaacgctgaccatgcactgcatatcattgagcgcaacacttccaacagtcctaccattattcgtgcgtttgtaagtgctatccttgctgcacgtgctgaaggattgaatattaacactgatacagtcggagaattatcaaagtatctgaacttattgggtggtacatatattctggattgtttgccttacgatactatttatgacaagatcttagcaaaggcccgtgagcttaccaaatgacaaaaaaggatggcctaagcaagttgctcagaccacccttctcttagtccttctctgtgtccaatgctttaaccaagcttcgcgcaattgcgtttgacaaaaccggaggaaccgcatttcctacctgctgatactgcgaatccttagaaccctcgaaaacaaaggtatctgggaaagtctgcaggcgggcagcctctcgaatagatatggctctgtccaattcaggatgcacccacatagattttcttacattcacaacagtgccagagggctcatcgtatcttaaacgcatataaatggtattttgcgttctttccgcattactgtacgtagtctttaactcagcccccagatcgtgaaaattctgaccttctttcaacgctgcaaaacgagcctgtgcaacctcgcgggttgccgtggctacatgattatacagcaactttccgcgaagagtttgagccaaagcacttaaattatccatccgaggtaattcaatagggggcgcatcgacttctgttgctacagagacattctgcaagtccgcaatagcgtcgcgcacagtgcggaatgtatcgcttgtaaactcgggtttcggaggatcataaacaattcccttttttgtcccaacaatagtaaagcgttctcttttctgcggtgcgccgtaatcaagagcattgtagacctttgctgtaatatcgtaattatatggtgcggcagataaaacactattgacataatcaaaaacagcataagactgtactgttgcgataactatgccattttcggaacgatattcagttacatggatgttattgtctaacagctcctgcatcctgcttaacatgcgctgcacagagagaggtatttcgatggcgcgaattaatgcgttaaattcaacttcctccccatgcatataggcaagcaacatgtgtgccatttcacgttcttgcgtccgtacccaatcgtcatcattggtcgcaacaatatctgccaatagtttggtgaggtactttcgatagcgctccatagagctggaaaacttaggttcattgatgcgaaagcggtataagacggtgattgctttgatttctttttcgtcccacatataagttttaatgttagagggatctttagcaaagctgaccgcatcagggaaattgatgccttttggcagcaactcaattttatcttcagagagagtcagtcccatgataacgggatcattgatatctgtttcctctaccataaatcgatggatgttggatttaagcatagctacattttccataacgaacgccttaggcttcagctctcgaacagcacgaacatactccttgaccagacgattgttcatgctgatgatggtggtatgctgacggtttgcatttgagaatccttgacagggaggccctccgatgactacatcgatttcaccgcacgattcctctaattccttataatcaattgtacggacatcggggtatagacgagccaacttgtgatttcgtttatatgtctttcgtgcgccgggattgttttctgcggctgccacaatttcaaattttcctgtctgcatgaatccgagactcaatcctcccgctcctgcaaacaggtctatcaccttataagccatttcggttaccttctcttcgttgtagtgaccattgggtccaagatatcattgcattcaaacaaatatgagaaatccgttaaggtatattcgctctgctcaaccaattagtcaagtataaaaatttaccaaaacaagcggaatctaatctgtatgttattgtcctgtgttatctgcgttttcgtaaacaatctctacaacatcagagaactgaacgccaaaaacagcacagatttttataagtgcatccatgctgatcatctcatcgcgtgacaattttgcaatggaggaggcacttaacccagtaagggcttgtaaatctttctttttcatgtttttatcaatcatgagttttagaagtctgtggtaactaattctcatatacgtacctcccttcaactgccctataatacatcaaaaactacgaaaaagcaatagaatttatgagaagatgaagttttcttctgtattcttgtagttttcgcccgcttatagggtgcaatacagcgatcagaaagcagagggatgaattatggcagacaatcattctaaagaagtgagaagcatgaatatgtcacatattcggagtaagggtaataagcctgaagaaatcgtgcggaagtttctgttttcgcaaggttttcgctaccgtaaaaatgttcgtagcttacctggctgtcctgacattgtccttcctaagtaccatactgttatttttgtaaatggatgtttttggcataagcacgattgtcctcgttttgtttggccgtcatctaatcaagaatattgggaacccaagatcctcggtaatgtagcgcgggacaaacgaaatagtgagttgctgcgcaaggcgggatggaaagttattgttgtttgggaatgtgaacttaagaagaagtgtagggaagaaacatttcgccggctggtctctaatatacagtccagccaataattgtcggcactaatatgtttgcaagtaataaatttatcgggaagcaactgacaaacctgtcgatagaaggcggccgtatatgccgataataatgccccacaaccagaaggcgctgagatttcgcagtctcagcgccttctgaatttatttttcttttcacttcccgttcaaactgtcccaatagatgcgcagcagatcttcggcctccctgcttttaaacaggaagaagcacacagcgccagccaacacccatataccataccccacatattccagccaggggtataggggcacaagatatcttccggccaaggtgatcacacccaggatggccacatagatgagcagcaccatcaacgcagtgtccagatagccaaagccctcgcgtctggagaccttgctccgtaattgtcgcagggcgcgcttgcggatgtcccggatattccgggaggtgcatttcttatcctgcgccacggattcggtagactcgccgttgattacagtgcggaacaggatctctcgctgcagctcggttagcccaagcagtccatcatgaatttctttgcgcagatacatcagcggatcttcctcagagccttccggcatgtatgacgcccggtcaaaccagcgcatatcgtcgtagatcgcattgcgcacttcctctgggagaaaggcttctgggttataggataccggttgcttgatcgcggattcttccagcggagtcgtgtcagtcagacgattaaattttgcctcactgtagtagagcacatgctcaagctctttccattcctccggatgctctgcgatccattggtctgcggcagcggcggctaccgggtccatggagtgtatccagcgccagtcggagcgaagctctttgtacgactgggtgtctttgaaggacataccttcactacactttctgcgttcataaaaagtttacaatttgagacattccgattctgccgattttctctaagtaatagtagaaggacaatttcacccgggtggagttgccttcggtttggtacggcacggcatccgcgctgacaaaccagaatgtgatcttcggcagagcagcctgagagagcatgcgtgctttcagccatacggcaatgcgctcggaaggtcattctatatctctgaccgtgctcccgggagcacggtctctttttattctaacatgaaggagatgaaaagccagtgtacagttgagagcaaatgtcgcatccagagagcaaaagaaaaaccgccgtgactgcggcaacagtccggcggctgggcgcacacacaggtgcgcgcaaatctactgacctaagtataacggccaggggacagaaaggcaatgaaaacttttgaccgttcactgtgtgagcgccatcaaacacaacgacacaggaggtatgttttgagttacaaaagatggccgaagcgcgatcccaacaagaattattttctggttcccaacgaagtctttcacatcggtctcacctacccggagatctctatctactgctacctgttgagcatcgaggacagagaaacctaccagtgctggcccagctacaagaccatcggcaaagcgctgggtatgtgcgaaaacaccgtgagtaagtatgtgcgcagcctggaggaaaaaggtctcatccgcactgagccgaccatggtacggagcaaggacggcagaccgctcaacggaaatctgctctacaccatctgcccgatccaggcggcggtggaattgttctacgagcggcagttccggcaactggaggaggatgccgcccgtcagagagcggcggcacgcctcgcagaatccgcccgtgaaagccccaagaaggccctgtgtgcgcctttcggagaggaagcgagtccctgtgccgagctgaacttggaaaccgaatttggccctctttcggggacgaaggaaaaagcaggataaagacctggcgtcgcaagcgccgcccggtcggccacttctgcccgcagtgcgggcagtttcgggggtacgaaagctggcgtctttgacgggcagaaaagatgccgttggcgtcagctttcccccaaagccccatattgcaggcttttcacagatgtctgatagagaaaaggaggaattcaatgagcaatgaaaccaaagagcgtttcccgctgcggatgaagccggaaaccagccggagactggagcagtggtacgctgccgacaactgcagaagcaaaaatgagtttgtggaaaaggcaatcaacttctatgtggactatctggaaactcaggacaaccaatccctgctgcccacggcgctccaggctgcgctggacggcagactgggtcggctggaggatcacatcgccaggtgggagttcaccagagaagtggaactggatctgctcatcgggatcatcgcagatgcagtggaggtggatcgggatgacctgaagcgcagacgagcggcgagcgttcgaaatgtgagagccaccaacggactcatctcgctggagaagcgcacacgctccgccggggagccggactgggatgatgacgaatggcaagactgattctgaaaagtccctacatcaaaagcaccggcggtgctgccggttacctccgctacatcgcaacgcgggagcgggtagagattcttccggatgatcgtccgcccacacgaaagcaggagcagctcatcgcaaagttggtgaaagacttcccggacaccaaaaccctctacgagtaccaggactaccagaccaagcccactaaggccgcggcctctgccttcatcggcctggcgctggaatccaactgggatgcgctccatcagtcggagcagtatatgaagtacatcgccacccggccccgtgcggagcggatcggctcccacgggctgttcggagacagtgacagtgtctcgctggaaaaggccatggaagaattggagcactacaccggcaatgtgtggacgcacatcatctctctcaagcgtgaagatgcggtgcgtctgggcttcgacaatgccacggcatggaaaaatctcatccgctcccaccgcaatgagatcgcagcggcgatgaagataccgtccggcgacttccgctggtacgccgccttccacgacgagggcgaacacccgcacatccacatgatggcctggtctgccaagcctggacaagcctacctctccaaagagggcatccggaagatcaaatccaagctgaccaacgacatcttccgaaacgagatgctccacatttatgagcagaagacagagtcccgggacgagttggtgcgggaagcacggcgcgccatgctggagctgatacagagtatgcgggagggcgtatgcaaccatccggatgcagagcagctcatgcagaaactggcggcgcagctggaaacggtcaagggtaagaaaacctacggctaccttcccaagcggctcaagcggctggtggacgagatcgtagacgagatggagcgacttcccgtcgtgcgccgctgctatgaacaatggctgatgcttcagggaaaggtggacagctattaccacgataagcccagggagcaaatcccgctctcccagcagaaagagttccgtcagatcaaaaacgccatcatccgggaatcggaacggctgcggcagggcgagatcaccttcgaagaacgggaccttggccagcaggacgagccggaccagttccgaaatggctcctatgagtactggagattgcaggagatcctccgggaggaacagatgacgctggaggagcggagcgaggcagtctgcgagttggagaagctggccaaggccggcgaccgctactctcaatacctgctgggcaaactctggcgggacggtcctctgctgatccccgatggagtggaagcacggtactggtttgaacaggctgcccggcaggggcatctggtagcacagcatgcccttgccaagctgtatctctctgacgatttggaggtacatgacaccgcacggggtgaggaatggctgcgctatgctgcggatggcggcagcagctgggccatgtatcggctgggcaaagaactgctccgtggcgagatcatggaaaaggatacggcaggtgcggtggattggttcacccaatctgccgagcgtgggaatccctatgcccagtatatgctgggcaagctgtacctcatgggaaaggaagtactccacgataaggaacaggctgacctctggctgacccggtctgcgaagcagggaaacgaatatgcccaataccttctggactacatggaagaagggcgttcaccctctgcgatgctggcggtgacacggctgcttcaccatatgagccgggtgttccaggacaactcccttcccaagtcccgtcccggcggaatccagatcgaccgcaagcggctcaaaaagctgcgggaaaagaaaatagccctgggccacaagccggatgaccatgaggagcagtggcctgaaatggccatgtaagcgacgcaggaaatgcgccacaaaacaaagaataaaatcccttccgatggaagggtagaaaggaatccaatgaaacgatccaaatacaactcttttagtgaacttcctctgatgctgaccgtacaggatgtggccgatgtgctgggcatcggactggctcacgcccttgaggtggcccaccggaaggatttccccaccatcaccctgggcagccgcattattgtcccccgtgataagctcatggcatggatcgatgagcaggccgcaaaaaaatctgaaatattgtgatagctatttccgagattctgtggtatttgtttgtgttgccaaaggagggatgatcaatggcaaagaaacgagcaaacggcgagggcagtatccgaaagaagcccaacggccgctgggagggcagatacacccagggcatcgaccccaacaccggccgagccattcagaaaagtgtgtctgccaggacacaggccgaatgcaaggagaagctggcaaaggccatccgggataaccgaggtatcccggtcaatcacaacgaggattacactgtggcggagtggtgcaggctgtggtttgaaacttacagcaagcctgtgatccgccccaacaccgccaagacctatgagaatgtcatcgagaaccacatcgtaccggccatcggaggagtcaaactcaagcggctcaccgccatccagattcagaagatgtacaacgattccaaaaccaaagggcgagtgcagcgcttcgagaagcagaccaacacggaattgtccggaagcacggttcgccgcatccacatggtattagccgcagcactgaaacaggcggtcaaggagcgaatcattccgtacaatccctgcgacaactgccgcatcccgcccaaagagcacaaggagatgaccatcatcccgccggagaagctgggggtgtacctcagcgaggcggagaagtatggtgtcctgcccatgttctttctggcgttgtccagcggcctgcggcgtggggaattgctggcgctccggtgggacgacctgaatgtgaaggaccgcatcctctcggtgagcaagcaggttactcggatcgacggggagctggtggtgacagagccaaaaaccaagaactccgtccgcaaggtggcgctgtcccagcaggcggtggccttgctggtgcaggagcatgaacagcacccggacagccctatcctgttcccgtcgccccgcaccggcggctactggagtccggacgcggtgtccaggatcaaccggaaactgctggcgaaggcgggcattgaggagcatgttcgcttccacgatctgcgtcacactttcgccacgatggccctatccagcggcgtggatgtgaagacgctgtccagcatgctgggccactacagcgccggatttaccctcgacacctatacgcacatcaccaatgatatgcagagaggtgcggcggaaaagattggcggcttcatggaaacggccacggccaagccggaatcggagccgtctgacccgccggaggagagccggtgcaaggtgataccgttcgagagagttgggtgagttaacagaagcacaggccaaggtcttaccggccttggcctgtgcttgtaacctttttcggcgcttcttgaaggagattcgactttatgctatgctgtgtttataaatatatatactgactaccatgatcagttgaaatgagggaagaacagcaatgactgaatttgaaaatcttaaagcgagctatactgccaccatacagtttggtttggctacaaatgttggctatctggaatctaaaagaggtaatgaagttcttcatgaattttgcaagcagctcgtggaaaatagcaattactgtgacaacgataaaagagctatgaaccatgagttagaactattaaaagaaactcttaacaaagagattgaggcatattatcagcacggttgatgtaatttcccataaaacatcctgtaattgttattccagttgcgatatgcgcttaagaatacatatccaacaatatttgcaattcggtgctgttagggatgggttagggatttggcggtttcggcggcaatcctcacccattctcccgccgcttttctgcccctgaaaccgtcgctgaacagcaatcgcccaaacggaaaaatcagaacaaaaagcgcagaaaaaccgcctttttaggcggtttttctgcgtgaggtggtcggagtgcggggactcgaaccccgggcctcctgctcccaaagcaagcgcgctaccaactgcgctacacccggttatgaagttttccaactgtggtcaaatatggggtcagcaccggtttttgaccagttaccggcgagagtgaaagcgctgtcagcacaagtgtcccaaggctttccgggttttccgaggacttcggctcgaacccgagcctcacgctcccaaacagttgaactaattttttgcggttatttctaattggttttaacccttgccgctcactctttgacactcttatttccactgtttccaatcgctccggcgctgtctgtggttatttatgtgatcaaaaacgtttcctgccccaaaccggtgatttttcaccagctcgggacgggtaacattttgtgtttcagattgtttggattgtaactctgagggcagggttatgcaagtgttttctgcccggagcgcagctcaaagtttgcggggcaatatacaaagagatggaattacattttttgtattgtttttgatgttatatagccgtttttgctccattccgcttgctctttaacactctttggatgaactgtttccgtgtgctccgagcggcactgtggctgaaaatgtggtcagggcagagtgccgctcgtatttgatcttcacagaacgaatttagtacactgttaacaaagataagaattttttacatcaagatccggcccgtgtctattcataggccgggctttttattggaccagtttctgcggacaagggattggtgcaatcctttacgattgaaattgatgacgaaaactcgcagattattgcgaaaaaatctaagatatagtatattataaaaagatcggattccaaacggaggtacacctatgtcagtttcatacaataaactctggaaacttctcatagacaagaaaataagtgtctcggatttgcgaaaatccgctaatattgcaccaaataccatgacaaaaatgcgaagagatgaagatgtctcacttgcggttctgcgtcgtatttgtgagtctttggacgtggatattggtgacattatggaattcactcgagataaagagaggatcgattaaaaaatggaatttagaccggaccagcaatctttgaatgaaaaagccaagttctctgagtggcataaatggcggctcctttttctgctgcttgaatccaatcaagtaaaccattctcattgggaggagtttgcccgagacctcacctataaaaaccgtttctcgtcggatagcgtagtggtgaaggaactcataaagcaggctgaacatgctacgcatatagttccacagggaacaacttttttcagggcaagacgatatgaacgttctccatatgaatggtttcttgctaattggatgagaaaaaatggcgccttggatgaggagatagaaaacgaggtaaataatatacaacctataaccaaaatgtttttcaaaacatttttctcggaagcatgttatttggaaggtgatgattttccaagtacaatcacatatacacccaaggatgcagtcaaagagtggaaagcacaagcgttcaaaggatttgatgctcaggcctccggatcccctgaccatagtaagattaaaggcgggagagcgaatccggattacatacggtatctttatctggccgaagatgctgataccgcctgttacgagatacgcccaatcatcgggcaaaacatcagtgttgcaacattcaagtcattgaagcaactgaagctgtacgatttgaccgatcaacggccaaaccgctttgaaaacccggtatatgaagctcccagcctgtttgactgtatcagcgagcacttttctatgccaaatgcagatgatcctcaaaaatatattccaacgcagtttttgacggaaaagattaaagagctgggctttgatggattgcggttcagaagttcgttgaaacaaggtggagtcaatattgtactgtttgagccggaaaattgcgaggcagtctcatcggagttggttgagataaagcagatttcgatggatatccgtccgtttgatattcgccctacggaatgaggtggtgctcgaaaaatgaatgtagctgagaaatttatggatttatcgattatacccgataaattgacaaaaaagaagcagcaaacgaataagaagattgagtatgtaagtgagtatgtgcgtctctgggcttttgttatgctggagcgagatgacattcacactctcaattttgttgactgcatgtgtaatgcaggcgtctaccgtgatggggattgttgtacagccatcgaagtattgcagattttttcttctttagcagaaaggtatccccataaaaattttcgtatttggtgcaatgataatgatcctgagaaaatagaagtcttaaagcgggttcttagcctttttccgaaaaaacagcaaatacaggtatttgccagtcggcttgatgtaaacgaatatcttgataggatctgtcaagatttggatttggccaagaaaatgtttatgcatggagctacaactatcctgtatgtagatccttttgactttggaactgtagagattccaaaggtctctgccgtgcttcaaaagcactattgcgaactgctgtttaatttctttatcagtgattatgtccgcaatatacatcaagatgctggacgtatagcaaaatgtctgggtggcgagagaatcgaaaccaaggacgatttggttgcatatatgcgtaaacaactacgagttggccacataaaacatttgttttcctatcaatttaggactgaaaagaatgttgagttataccagattgtctttgctaccccaagctccagaggattagaaaaattaaaagaggcgctttggaaggtttttaagggtgctgagtttcatcgcaaccatacagatagtggtcagatgtgcctttttacggccaaggataacgaggatttctctttgcacacatacgccactgaagcaaggattttattatgtcaaaaatatatgggacagaccgtttcctggaatgatcttgaactttttctgattgaacataccatgctgaaagaagctcaaattatcaggcatgtgctgtgtccgctaattaagactggagcaattaagaaacacaatctttatggaaaaagtaattacaaggcggactcttacacattttctgaccaaggagaacttcaatgatacgaaaaacgctgatttacaaaacaggggtagaatatggcgattataccctaaatcatattcaagggtgctctcacggctgcaaatacccctgctatgcatacatgatggccaaacgatttgggaaggtaaaaagttatgaggaatggattcatccgcagatcgtggagaataccatgcagcttttagcaaaagaactccctcgattcaaagacaaaatcaacttgcttcatctatgctttacaaccgatcccttcatgtatggacacgaagacatttgtcagctgagtatgcaagttcttcaaagagcgaatgcacatggtgtccgctgttccgttctcacaaaaggaatccttcctattgagctggccgagttgcccttgcaaaatgaatacgggatcacggttgtgtctttagatgacgacttcattcggcgatatgaaccaggcgcggcaccaatacatgacaggattgatgcattgaaggtgctaagcgaaaaaggctgcaaaacatgggtcagcgtagaaccctatccaacgcccaatatcatcaaacaaagtctaagcaatatcctggacgcagtctcctttacggatcggattatttttggtagacttcactacaacaaagtggtttctgagtataagcagcacaaggaattctataatcaatgtgcagagcaggttattcaattttgcaaagaccatcagatcgattaccatatcaaaacaggtacaataacagaataggaggacagttgcatggcacgtccgagaaaacaactaacagatacagagaagatgcgtgatgtagaggcatatacccatgatgataaaaagagaaccaataacccgccagtgggcatggctcagcatgataaggcggaggagaagttgaagacctatcagtttgacccgcaccttgatcctacacttcaatgggcgggcaaggccgaaggcaccagctttgatgtgcctacatcctctatccacattcatgagtccattaaaccacacagcattgttgctcgtgtgatgaaggaatactccaacacattagaagggcagatggaaggacagcaaacgttctttgctgcagagactccggcagagcggatgcgccgccgccgggagtccattgagttttaccagcacggcgttaactggaccaaccggatgattgctggggacagcctggtgattatgaactctctgctggagaaagagggcatggccgggcaggtgcagatggtgtatatcgatccgccctatggcatcaagtatggctctaatttccagccctttgtggacaagcgggatgtgaaggataaaaaggatgaagatctgtcccaggaaccggagatgatcaaggccttccgggacacctgggaactgggcatccactcttatcttacttatctgagaaatcggctgctgttggcacgggaactactgacggatagtggtagtgtgtttgtacaaatcagcggcgaaaatgtacatcacatccgagaattatgtagcgaaatatttggagaaaacaactttgtttccctgattccatttaaaaaaaccagcggaaagttatccgctggcttagataatgttaatgattatattattcaatatgcaaaggacaaatcttttttgaagtatcatcaactatatctgcctcaagttgatgagtttagcctgtatacatggattaaaactgctgatggcaacgagcggaaacttacatctgaagaaaaacgaagtcgaataataccgcaaggaagtgttttgttcagaacagctgcgttgacatcgcaaagcggtggtgacaactccagttttggggtacagtttcaaggcaaaacttattacccagcagtcaatacttattggaaaacaaatgaaaaaggaatggaaaacttaattgccagagacagggtatgtggcattgggaaaacacttgcatacaaaaggttttcctctgattttccggttcgtcgattaaccaattggtgggatgacacgatccagagtacattcgcaacagaaaatatttatgtcgtgcaaacatatacaaaagtaattcaacgctgtatgctcatgaccaccgatcctggcgacctggttctcgacatcacctgcggcagcggtactactgcttatgtagctgaacagtggggacgtcgctggattacctgcgatacttcccgtgtggcaatcacgctggcaaagcagcgtctgatgacggctaccttcgactattacaaactggcccatgaggagcagggtgtgggcagtggatttgtctataagacggtgccccacattaccctgaaatccatcgccaacaacgagccgcccgcaacggaaaccctgtatgatcagcctgaaatcgacaagggcaaggttcgtatcaccggccccttcactgtggaggccctgcccgctcccgtggtaaagccgctggatgatgtaagtgactgggacgaggactccactgctaagcagaccagctggcgggatcagctgctggccaccggcatcatgggccggggcggcagccggttggagttcagccgtgtggagccactgtccggcaccaaatttcttcaagtggaagcggagaccaaggaggatgtgccccgtagggcggtgatctgtttcgccggagaaaccaagcctatggactcccgcaaggtattcatggctctggacgaggtggaaactctgcgtccggctcccaagctggtgatttttgccgctttccagtttgacccggaggcagccaaggacattgatgagttgaactggccggggcttactatcttgaaagctcaaatgaacacagacctgatgaccgacgatctgaagaaaaagcggtcttccgaccagtccttctggctggtgggccagccggatgtggagctgattccggacaagcgcagcaagacccgctacaaggtcaaagtcaacgggttcgattactacgatgtgaaggagggcacggtggaatccggcagcacctcccgtatttccatgtggatgctggacacagactatgacgggatgtgcctgcagcctacacaggtgttcttccccatgggcggcaagaaggacggctggaacaagctggccaagacgctgaaggcggagatcgatcccgacctgattgaaaagtatgcgggcaatgaatccctctggtttacggtacagcccaattcccagattgcagtgaaaatcattgatgaccgtggaattgaaagcctgaaggtcatgagagtaggtgatgaataatggctggaattgaccaactcattatcaactctgcctttcgggaaccggagcatcactggaaatatgacctgaacggccagacctttgtgcaggaaccgggacggcggcctgccggttatttcgttgccggtcagggctctaaccagtataatgacattggacagtttatcgaactgcctctggtcaacaagattcggccccgagtgaaggcgtggcggcaggccgggtatcccggcgtaaccggcgtgacccaaaaactgctggatcactggaacgataaggacgctcggcagtatcagttcttcttctgtcagatggacgccatcgaaaccattatctggctcacggaagcgcctgatgctgagaaggtgggtatcgagatccccggagatggtggcctgttccgacgtatctgcaccaagctatgtaccggcggcggaaagactacggttatggccatgctgattgcttggatggtctgcaataaggctacctatccgcaggacaagcggttctccaaaaatgtgttcattgtggctcccggcctgaccgtcaaaagccgtctgcaggtactgcaaacaggcggcgaggataattactatacccagttcagcgtggtgcctgtcggtttgatggacaagctgcggcagggcaaagtgttgatcaccaactggcaggcgctggcttgggacagcgaggaagccatcaaaaagcgccggagtgtggataagcggggagccaaaagtgatgaagcctacacccgtgaggtgttgggagagatggccaatgctcagaatattttggtcatcaacgatgaagcccaccacgcatggcgaaaaaacccggaaaataaagggaaactgacaaaggagcagaaagtagcggaacaggaggccacaatctggattagcggcttggatcgtatccacaagacccggaatattctgacctgttatgatttttcggccacgccctttgctccatccggcaagcgaaacgacgaggaagccttgttcggatggattgtcagcgattttggtctgaatgatggtattgaatccggtttggtcaagacgcctcgtgttgtggtgagggatgatgggacgccggatgcggggagttttcgttctaaattgtatcacatctatgcagacgatacggtgcgggatgatattaaccgtgcagccccgccggaggaaccgttgcccgacctgctgattcaagcatactacctgctgggaaaggactggcaggttctgtatcaggcatggcaagaggctggtgctgttgttccgccggtaatgattacggtagcaaaccgaactgaaacggcggcccgtattaagtatgcttttgaccatcagcgaattcctgtacaagagctgtgtgtgccagaactgacggtgcatatcgattccaaaaccatggatgaagcagaaggaaccgctgcacctgaactcagcgatactgacgaagatggcggcgtgcgaaaattaagtagagcagaggccgcagcaatcttgcgggaaaccgttgatactgttggacagcgtggaaaacggggcgagcagatccgaaatgtgatctctgtgggtatgttgtctgaaggctgggatgccaaaacagtcactcatattcttggacttcgtgctttttccagtcagctgctctgtgagcaggtggttggccgtggcctgcgccgcacatcttacgatctggcagaaggcagcgatatgttcacagcggagtatgtgaatatctttgggattccatttactttccttccccatgagtcagatgaaaccggtgcgccccccacaacgccgccgaaaacccaggtggaagcgctgaaagaacggatggaatacgccatcagctggcccaatatcattcgaatcgaccgggagtttaagccgaaactgtccgtggacttggataagatcgatatgctgacattggaagcggcggacacacgcctgcgagcagatcttgctcccattattgacggaaaaacggatctgaccaagtgtacggagatcgatctgcaaaaacttgatgcagaacttcgtatgcagcgtattgtgtttgaggcatctgggcaggtctatgacctgatgaagtcatcttggaaaagcgagggaaccaagtatgctttgcttggccaggtgatccgtttggtggaagaatacctgaaatcaggcgctattgcaatcaatcctcccttgttcaacacagacccggtgagacagcgtatcatctacatgatgaacatgaataaaattgtgcagcatctgtggggttttatcaaactggagcagacagaacgaatcgttccgatttttgatcagaataaaagagttcgctctaccaacgatatgcccacttggtttaccagcaaaccttgcttcatcacacagcactcgcagattagccactgtgtgtttgacagtgcatgggaggcgacggaaagctacgtgctggagaaaaatccccatgttattgcctgggctaagaacgaccatttgggatttgaaattctatatgtgtttgacggtgtagtccgaaaatatacgcctgacttcctggttaagttggataatggaaagacattggttttggagactaaggggcaagagactcgccgtgacaaagaaaaacaaaaagcacttgctgaatgggtcgccgctgtaaaccagtgcggagaattcggtgagtggtgcaatgatgtatcgtacaatgtggcagatgtggatggtattattgtaaaacacctataagcataagaatctgcctgggtatccgttacccaggcagatttatttaactaatgaacacaaaaaatgacctcaatattcaaaataagaatatcttactgcatgtcattcgtcttcatatgtaggttgttgtagttgccgcttatctgactgctccaccatccgcttagcccggcgaagtttccatgcaaggctatccagacaccgctcccgcagacgctggatcgcctgatccttggccttctccacgccggactccttcatgcggctgcgcatggcgatttcccgcaggtccgacttgggataaccatacacgccgaagcaccgccccaggatgtcctggtccctcttgaaaagctgcataaactcttctcgaaggcattccatggtcaacatgcggatcacagcatcctccgcagaacctgaaaggcggttcgtggtaaaccgcacaaaaatatcgccgtcatcatccgggtcttgcagatcataaacagaaaagaaatgggtggggtaggcaatcgccctggccgccgcacgaaaagagatgcccaacacctggctaatctcatccacactctgccctttttgatgatagcggttctgcgcctttcgcaccaatcccatgctgtcccgatccagagcaagcgttcccatgctgcattccagatgccgccgcatggctccatccagaaacggggtgacataggtggtgaaccgccccttctctgcatcatagccgccgccccggacgcactccaccagcgccagctttcccatgctctccagttcggagagcattctttttgcgtaatcaatcagaccgccgtatttggtttgccgcagacagtgataccgctgggcgatcaccgggctcgctccctaaccaggccggtgtttctcaggcacagcttggtcagggccgcctcatcgccgctggcgatccgctccaacagttcctcgttggtcatgccccatcaccgtccttcgtcttgcggggacggccccgtggcttggcctgacgggccactctgcaaagcggataaagatgccgagaggagatggaacgctcaaaatcttcattggaaatatcgaaactgctcagcgcgtcaaacagcctgtcccgcacagtatccttcagccgtcgcatttcctcctccgtgataataccccgctgataatccttccggatgcggttgaaggcggtaattttgaccttgatttttgggacatcccgtgaccgttccttctgaacctcatagctgccatactgccggcaggtaaaacgctcgttcagcggacagctgccctcacagtagagaacatgggcaccgcttcgcaccagaaaatagttcttgcagacaatgcaacgccggatgttgtatccaatgttcagggctgtcatataatctgccttcaacagcatctgcaaactgtcggtggtatgctcctggcagatggcaaacttcccatccggcaatgcccgtggtacatagctcaccacacagtggtcgtatttctgataaaaggaatgttccaggctgatgggatttgcgatcagcttctccaccaggcgctcgtcgtgataaaactgatagagcgcagtggcgtaattctcggaagaattgtgttccagcttggagaggatgaagttgataaagttgcggatggtatggttgaacgccgccacttcttccaggtaacgctggcagcggtcaatctgcttgcggtagtacagccatttttctttgcggctaccaggatagatgagaaggtgcgggggaatggtttggctctcttcctcctgcgctgctgcagcttcccactgctccggggttgtcatacggcagtccatctcctcctctggaagaaaggcaagctgctcggtgtactgctgggcttcctgaaaaagctgctggtcatcccgcagcaggatttgaaacatccggtacttgctcaactgtctgcgcagttctatcagacagcagttcagctcccaacgccacggtcctgtgtgctctcgtactgcctggccagggacaggatatgctgcagctggtcatggagaggggcgtactccctggggcccagattcaaaatatccgtggtcagctcccccgcatcaaacagcgtgccgccgtattcgaccgtgctgccgtgaatgtaaaatacgatatctccgtccacaagaccctcaccgccgcgaataattgtcccacccaaaaaaaaatggtcacgcctttttcttagtctaacaaaatctccgacacaatacaagcagaaggacatcagcacggaagctggtgtccttactttttgtaaaggagaatcacaatgaagcaatccatatacaaacactacgacgagctgccgctgtttctcaattcggaaacggtggcgaaagtgctgggcgtgtcaccgtccagtgggtatgaactcatgcaccaaccaggattcccggtgctgcgagtgggcagccgcatggtggtacccaaggagcagttcatccgatgggtggaagaacacacggagagaggtgaacgcagatgaatttgttttcgcctcagcgtgatccgaaacgaaaccgcttttcactccccaatgatatctggaagtggcaactgaagcctcaggcgttcgccatcctgacctatctctgctatctccatgcccacggtcaaaaatctgtcccaccgggtgtggacgagttggcctccaagctgcacatgagcaaggacatggctacgtcgcagctctccgaactgcatcatcgtggtcttctggagcaacaaatggctccggcgctccagagcagcggcaagcattttttctctctgcccaatgaactgttcttcctggatcttggtcacggagctatcacggtctacgcctatctgctctactgcgaagaccgcagaactcatcagtgtcatccaagctaccgaaccattgctgctgcggcgcatcttactgtatccactgtgatgaaacacatcgcaaagctggaggaccgacagctcatcgccgtggagagtaccagctacctggacagccgaggcatgaagtggaaaggcaacaaccgatacaccatcctgcctattcaggcagcggtggactactgctaccagcagcagatgcgccgcttggaggaacggcaaaaatggcagcaggcacagaaacgcctgggacagaaccagacaaacgccccgtgtgccccgctgtgatgggctgtgtgcccgccttcggggcagggtggcatccctgccccgccgagggctttgggggcggatttgggccgatttcgagcaaggcttcggaacgggggcacggggggacgaggagcaggagaaagccctggcgcttttgtgcgcccgggcagtcacaaccgcccgcagtgcgggcggtttcgggggacggaagctggcgcttttccgaaacgcccgaactacgattgacgctgttttccaaaaaacaggcgaatatccccgcagttgggacattttcgctgacgctatcacggattcaggaggtgcttgatcatgagtgaaaacagacaccgacacaccgtttggatggacgatactgtgtgggatcaggtggagtcccactaccagaaggacaactgctccaccaaaaatgagtatatcgagaaggcgatccggttctactctggctatctggacacgaaggatgcggacgattacctgccccgtgtcctctctgatgtgctggagggaaagctgggcgccctcggtaagcggatgggccacctgatcttcaagcagtcggtggagcaggatgtgctggcgaacctgttcgcctacggactcgatgtggacatggataccctgcaaaagcttcgggtgcggtgcgtcaaggaggtgcgggagaccaacggtgagatcagcctgtaggacgctctgctctatcaaaagggggctgaagtgtgaccggcctaattcaaaagtccagctacatcaagccgggcagcggcggcgggcactacgccaggtacatcgccacccgggagggtgtggagcttgcggaagcaccgcaaccctcccaccagggcggcggctacctggactatatggcccagcggccccgctctcacggtttgttttcggtggacggccccgccgatctggagaaaaccatggaggagatcaacgcccattctggtccggtgtggaccttcgtctactccctgcggcgggaggatgccgcacggctgagctacgaaaccagcgagagctggcgcagattgctgctggctcatcaggcggagctggcggcggcgatgaagattccacccgacagctttcgctggtgtgccgccttccacgatgaaaagcaccacccccgcatccacatgatggcctggtccgccgacccgaagcagggcttcctgaccgagaaaggcatcgagcagatgcgctcccagctgtccaacgacatctttcggggcgagctgttgtccctgtatcaggaaaaggatcacccctacaaagaggtgcgggacgcagccatggaggccatgggtcgtctcattcgggagatgaagtccggactctgtgacagtcctgttatcgccgggcagatggaagtgctggccggaaccaagggcaaaaaggtgtacggctatctgaaaaagccggtgaagattcaggtgaatgccattgtggacgagcttgccaggctcccggaggtggcggagtgctatgaacactggaaccggatgcgggatgaagtggagcgatactacaaggacgcgccgcgggaacacaaaccattgtcacagcaacaggaattcaaagccatcaagaacatggtcattcgggaggcggaaaatctcaggctgggcaagtgctggcgggatggtatgggtgtgctcccggatgacaagcgggcggagctgtggtttcgccgggccgccgaggcaggtcacgacttctcccagtacgccctcggcaaactgctgcaaagtcaaaaacggatggcagaagcggcgtactggtataaaaaagcggcggcgcagggcaatccctacgccgcctaccggctggggaagctgtatctggagggaaaggatgtcccaaaggatagcgccaaggcgctggagtatctgaacgcttccgcccagcagggcaaccagtatgcccagtacactctgggcaagctgtacctcaccggcgaaggtgtggctcaagaccgggaacaggcataccgctggttccaggcgtcagcatcccagaggaacgagtacgcccagttctttctggatcacttcaacgacgctcgcagtcccaatgtccttctggcagtcaccagactgctcaaccacctgagccggatctttcaagagaactccgtgccgcccgttccgccgggcagaacggaccgcaagctgctccagaagatccgccagaagaagatcgctcagggtcacaagccggacgaccatgaggaggagcagagccagggcatgaccatgggcggatggtaagaaaaatagcacggcgttaacaatgataaggggcgaacagaaatgggccggagaaattgataacaatctgataactgtggtcaaagtccctggctattttctcagtagttcggtattgtgtattgctgaaaaggaggcgacgcaccatgaacgactgcatgagagcattgcatcagcggttcttccgggagccggatgtgtcagaattggaagcagacattgagaacacccggcaggaagtgcgggactgtttagataagacgcagcggcgcagtctcatgcatctggtggacagtcagaacctgctgaaagaacaaatctctctggccagcttcatcgccgggttcaaactggcctgggggctgagcaaagaactggaggcggacgggctgtacttcttcgacgagaaggaactggagcgcgcctgtctccaatgcggaaaggaggagtgaatgtatgggaaaacgcaggccatccggggacggcatggtccgcaagcgggacaatggccgctgggaaggccgcatcgtcgtgggccacaaggacaacggcgactccattttccgctacatctacgccgatacccaaaaagaactgactgccaagctgcggcagaacatcgatgcctaccagggcgtggatctgaccgaggacagccgcatgacccttagcgaatggctggaccgatggctggagcgtatgacgggagcagtcaatccgcttacgatgaaacgatatgagggaacggtcgtctggcacatcaaaccgtatctgggagaggaaatcatctcccaggtcacagggaaagacatccaaaagctgtatgatatactggcccgtcatggaaacaaaattactggagaggggctggccagcggaacgattcgaggcattcatgccatgttccatgaggcaatgggagctgctcagcaggctggcctaattcccagaaatcccacagaggacatcgacgcgcccaaattcagctacaaggccaaaaaggtgttaaccgaggcgcagctggaaaggttcatggaagccattcgtgcggacgagatctggtgcgacttcttctatacggaactgaccacaggtttgcgtcgtggtgagatctgcgggctcaagtgggaggactttgacgaggccaaaggaacattgaggattcgccgcacgatccatgaggagaagggcggcaaactgactccctgggataccaagactgctgccggtactcgcaccatcaacctggcgcccagtactgcggcactgcttcgggagaggaaaaagacggccctgacggaatggatctttccgcatccgctgaaaccggagcagcctacccgacaagtgccgcctatgagtggatgaagggtctactgaaacaggcagagcttcctgatattcggttccatgatctcagacacactttcgcgacccacgcactaacatcaggggtggatgttaagaccctgtctggtatcctgggacacacacgagccgcattcactctggatacctatacgcatacaacaggcggatatgcaaaagagagcggctgagatcgtagaggaatttctcgtcgacatcttcggagaggagttgaaaccatgggaagaaagcggaaaaatggcgaatgtaccgtccgcctgagaaaggacggccgatgggaaggccgagttgtcgtcgggtatgacgagaagggccttcccaagacaaaaaatgtgctggtaaaaacaaagggcgagtgcatagaaaaattgaaggccctgaaaagtaccatcacaccggacacgcctgtaaaactcaaagccgatatgtcgttcggggagtggctggagtactggtatgaaacctattgcaagcccaatgtcagaccaggaacgcagagcaactatgaggggcatatccgatggtatctccagcccaaactgggcagcataccactaaataagctgacagtcggcgatatccagcagatgtgtacctggatgatgacggaggcccgcatagaccccaaaaacggcgatggcggtctctcggacagtcaggtgcgaaactgttacagcctatgtgaacgggtactggaaaaagcggtggcagtaaatttgattgcccgaaacccggcaaagggctgtaagctgccgccgatccggcggaaagagatgaagattctctctcgagaagatattcagaaggtgctgatccaagctaaggaggaaaattactatgagctcttccttctggaatttgccaccggcctgcggctgggggaattgatggctctccagtgggacgatgtgaatctaaccactggggaactgaggattaacaagcaggcaaatctggctggctcgaagctggtgatcagtgagccgaaaaccaaggcggctgttcgtaccctgatcctgcccccagctgtcaggaaggtgctggcggagtacaagaccagagtgaactcccggtggttattcccctcgcccaagaaagaggatctgcccatacgtccctcggtagtgagcctgcggctccgcaggatattgaatcatgcggggtgtgagccggtaaggtttcatgatcttaggcatactttcgcaaccaacgccctggcttatggaatggacatcaagacgctgtccacaatcttgggccatgtatccagcgccaccaccctaaacacctactcccatgtcaccgatgaaatgcggcagagagcggcggtgaagatcgaccagggtatcgccaaggcagaggtgcaggaggatgcagccgctgcccgacctgagcgcaccatgactacattccgtgcgagaaaacgctggagccgagaggccagctaagaccaatctaccggcccatcaggggattccacccctggtgggccggttttcgctgtctgtgggcaaacatgtggtcaaaaggggaacaagaagaaatggtatccagaacttacgcagaaaatggcgctggttgcgggatgtttgcccactttcgaggagattcagcgggtgaagttgtggcggctattggttggactgggagaagcaaagaataggggctgacatagctgtgcgcttcatgaaaacttattcgcccaagcagcgagcgcctgatcagatacgccgttttccagtttttcggctttccagtccgcgttcaggcagagttttctcagcccgtccacagtttttcccatgccgctgccgccggaggtggcaacgggcaccaacgtcttgccggaaaaattgcagctttccaagaatgtatggataatatggagcgcaacataccatcaaatcgggaagccgatgaacaccgtgtcgtaatccactatgttgggaatcgtttcggtgatttccgggcaggagtacgggccatccattttcacgctgctgcggctctttttgcccacccagttcaggccggcgctggtataagcaatggtgggcttgatctcaagcaggtctgcgcctgcgacctttgcctaacgttccgcggcctttttcgtcgtgccgcttgtggaaaaacaggctacccatctcagtatttctccaattcgttatattcttcatcactgaccggtttgtaccagattcctgtttttccctccaaaacgatcagcccatatattgtctgaagaacgcttccatcttgtcaaaggggatcacatccagccggtcatagaggtcggtatgtatcgcacccggaatgatgagcaactccttgttgtcgccggtcagcttttcaaaggcgtccctgctgaagtagcaggaatgtgctttctctccatggatcagcagcaccgcgctgcggatctcgcggctgtactgcaaaagcggcatattcagaaaaggcagcgcagaagtgacattccaaccctcgttggagttcagcgaccgtgcgtgatacccacggctggtcttgtaatagtcgtggtagtcattcacaaagaagggtgcgtcctccggcagcgggtccaccacgccgcctgcccgggcataggtcccgtttttgtagtcggccgtccgctgggcgttcagggccttgcgtttttcatagcgtgcttcctcgctgtcctctgcgtcaaagtaccctttggcgttcacccgggtcatgtcatacatggtggatgcgacagtcgccttgatcctggtgtcattggccgccgcgttcagcgccatgccgccccagccgcagataccgatgatcccgattctctccgggtccacattgtcctgaacggaaagaaaatccaccgccgcggagaagtcctccgtgttgatgtccggggatgccacatactggggagcgccgccgctctccccagtaaaggacgggtcgaaggcgatggtcaaaaagccacgctccgccatggcctgcgcgtacagtccggaggactgctcttttaccgcgccaaagggtccgcccaccgcaatggccgggagcttcccctccgcgtttttcggaagatacagatccgccgcaagggtgattccataacggttatggaaggtggtcttgcaatggtctgctttttcgcttttgggaaataccttgtcccattcctgtgtcaaatttagctgctccatactcaggcctccttacccatccgataggctttctccagtgctgggagacctgcaatgtcgcctacgccattgacgccgcctgcaaagacggtgcctgccagctcacaccgttcaaagcagtccgcccagccctgcacagccttgacggttccttccacagtatcagccccatcctctgccgctgcggccatgaggtatgccttggtgaaagcgtaatcggaatcaaaaagggggttggcacgatccagcatggtcttgagctgaccactgatgctgtaatagtaaacaggcgtggcaaataccagcacatccgcatcgtgcattctggcggcgatctccacagcgtcatcctcgatcacacaatgaccaagcttgagacaagccagacagcccttgcagaagccgtatttcttctcccgaagataaacggtttctacctcgtgaccggcttcctcggcaccttttgcgaaggacgcggccaatgtttcggaattgccgcccttgcgggggctcgaattgatgatcagaacatgtttgctcataaaaaactcctttttgtgtcttgcattgtgattgatttgctgataaactcatgatagtacctaaacctaacttcatgtcaagtactatttttgaggttttctcagttattttggaggaaattttatgtataccatcggccaagtatccgaactgtttgggctgcctatctccacactgcggtattatgacaaggaagggctgttccccacgatccaaagagattccggcattcgaaaattcggagaaaaagagctggaagcccttcgggtgatcgagtgcctaaaaaagtccgggctggagatcaaggacatcaaacagttcatggagtggtgcgtacagggcagcgaaacctatccgcagcggcgggaactgttcctccatcagaaggcggcggtggaggcggagatcgagcggatgaaccgggtcctggacatgcttcgcttcaagtgctggtattatgaacaggcgatccagggcggaaatgaagaccgtctttcccgcttgcagccggaggacatgccggaggagatccggcgggcttatgaacatgcacacagcatggatgcgtagaacgggaaagcctgagagcacgctgcctgttctatggcctttttcatctttttaaagcgcctcaaaatgatatctgggcttgcccaggctctttttgccgtactcgatgatttccacaggacagcggcagatgcacgccatgcagtggatgcagccgccgccccaaacaggcctgccgttttgaatcgtgatgttgttggttgggcagggcctggtacactggccgcacactgttcctggaactcggcgccggcggaaacacccctggaattatcaaagtgcctttcctgcgtatgacggcttagaatcccaaagtcacctacgcctgcatcaacctgggcagggccatcaccatgagaggcattgaagtgcagttcatcctgcttgacgctgatattggtgttgagcgggtagaaataaccgaaaagaataaagtaaaacgcttcccccagagcccagtgatgagtaagtcacactgacttgggggaagcgtttctttttaattccagtaacacctggacagtattcgttttcttttagagtctctgcgctttcttttcttagattgttcagaacctccggggcaaatacatcctgatattgttccttaataaactcgctgatattgggatgttaagtccattgattaggatcttttccatgcttattcccaagatatttaagcagggacgccagatcgatgtttagctccttctctttaataaaaatagcgttctccaatttcgctctgaaagtaagcgtgaaataacttagtccacgcgataagcataagaataatatcattctcaattataaattgcacacatgggcgattatacgtttcaactgcggttagcgcattattgatgaaattctctggaatgttttttgcctccccttgccgcaggataatcatagtgctacctccctcttaaaataaaaaccgcatgggaacatgcccatacggtcgccttggtgacgcaaaggctcaccgcagaattatcataaaggataagaccgaaaaattcaggaatccgccgtatctacaatgaagaatacggcagtcccgccaattagcgatggggtagggatttggcagtttcagccgctattctcactcatgtgcctaccgcctctctcggccttgaatcaccgctgaacagcaatcgtcaaagctgcaaaaaatgaacttaaaatgcagaaaaaccgcctgttaggcggtttttcaaagaaaggtggtcgaggtgacaggattcgaacccgcggcatcttggtcccaaaccaagcgcgctaccaactgcgctacacctcgatgataacttagttatcataccatacgccttcatcggatgtcaagatattgttgcgctcctggtataatattgtttagcgattttttcgctaaacaacggcgatcagatgatggatatgataagatgacaccggggtgattttgttgtatgataggcttcgatatctccgaaaaaaacatcattggtcgcaggagcagcttgccaaacgactgtattgcagtcaacaacaatatagcgcatatgaatgcgggcatacagatataccggtatgggtattgttgcgcctatcatccatttatcatacgagttgtgattatctgctcggcttaacggatgattcaacgccaaaataatcggaggggcggtgcttcgcaccgccccccattttcctatttaaaacgcgattttcgccttgagataatcgcagagcgaatcaatggcaatccgctcctgcgccatggtgtcgcggtcgcgcacggttacacagccgtcggtttcgctttcaaagtcataggtgatgcagacaggcgtgccgatctcatcctggcggcggtaccgcttgccgatggaaccggcgtcgtcataatcaaccatatattcctttgcgagtgtctcatagattttccccgcgccctcagccagctttttcgaaagcggcaacacgcaggctttatacggcgcgagcgccggatgcaggcgcatcacaacgcgcatatcctccttgccttttgcgtccgtaccgacgatctcctcgtcatacgcgtcgcacaaaaacgccagcgccacacggtccgcgccaagagacggctcaacaacatacggcacataccgttcgttcgtctcgggatcgaaataatcgagcgtcttgcccgaatgctcgccgtgccgtcccaaatcataatccgtgcggtcggcgatcccccacaattcgccccacccgaatgggaacaaatattcgatatcggtcgtcgctttggaataaaacgacagctcctccttggcatgatcgcgcagacgcatattctcctttgccatgccgagcgacagaagccagttttcacagaagctgcgccaatactggaaccattccaaatccgtatcaggcttgcagaaaaactccagctccatctgctcaaattcacggatgcggaaaataaaattgccgggcgtaatttcattgcggaagctcttgccgatctgacagacgccgaacggcacctttttgcgcgtggtgcgctgaacgttcataaaattgacgaagatcccctgcgccgtttccgggcgcaaatatagttcgcttttcgcatcctcagtgacgccctggaacgttttaaacatcaggttgaacttgcggatatctgtaaaatttgtgccgccgcactccgggcacttaatgttatgctccctgatatacgccagcatctgctcattgctccagccgtccgcggcctcgccggttgcgtcctcaatcagcttgtcggcgcggtggcgcgttttgcagtctttgcaatccatcagcggatcggaaaagccgcccacatggcccgaagcgacccatacctgcgggttcatcaggatggcggaatcaagtcccacattgtaaggcgattcctgtacgaattttttccaccacgcgcgtttgacgttgttcttaaattcaacgcccagcgggccgtagtcccatgaattggaaagcccgccgtaaatctccgagcctggataaacaaatcctcggcttttacagagatttacaatcttttccatggttttttcactgctgttcaaaatacgctcatcctctcaaggttatattctaaataaaaactggccggggttccgattagggcctgtttgaaaatagaggaattgccggatttttcgcagacagcaggagaatgcaaggcaaaaaacgcaggaatcctttcggattccgaggctttttaacgcggcattcgccgctgtttgtagaaaaagacagtatttccgatttttcaaacagcccctagaaaaaaagaccggaaggcggggagcttgcaggaaacgcgccagccgcgcggcgtctgtcatgcttcctgccgatgtaaggccccgcgtctgaacaggtgtcttgcggcccgcaggccgctgcgcttgcccggccggctattcggggctttccggcactatagcgccgggcgtggacaagccgcggcagcgccccttttcgcgcctcacgggacaggggcgggccgcccctatcccatggacccaaccctggggcgggcgcagcctatattaacgcggcgccaaacccactgttcgcggcgcagccggctaaagttttttgccgagctttttttcaaaaaagcggggcgcagccggctaaagttttttgccgggctttttttcaaaaaagcgggggcgcagccggctaaagttttctgccaggcattttttcaaaaaagcttggactggtcgaggcggtcaaagccgtcgagaagggtgcggacgacagcgcagaggcggtcgcagtcgccgggacggttgccctccatattcagcggcataagcggatcgtgcagcgacaggcgaagcagcacccagccctgaacctgctcgctgtcaaacgtcaggcgcacgccctcgtaggagttgggcgccacagcgtaaccggcggccctggcgcgctgctcgaactgctcgagcacctgctggccatatgctttgaaatcctctccgctgatattcatgcggtattcgcggcattcaaactgcctgggcagtttttcgatcagcgtatcgatgcgcttgccctcccggcgggccttcgcggccgcaatcaacagcttgacggcaagatatgcgccgtcgtctaggaaatagttttcactcagcgcgccatggcccgaggtttcaatcgccagcggcgactgtacgccggccgcgttgaggcgcttggattcattgatgacgttcttatagccgcgtttaaagcggtgatgcctgagatgcagcgtgttctccagaaaatcggtcagcttgtccgaggtcacggaatccgtaacgatcgtaccgcccggataatccggcgcgataatcgcggaaatcatcgcgatgatcgcatcgcggttgacctcgctgccgtcgtgcaggaccgcggacatgcggtcgacatccgtatcaaatataatacccatatccgcatgatgctccactgtcgcggcgcgcacagaatccatagcctgcttgttttcaggattggggatatggttgggaaacatgccgtccggctccaaaaactgacttccggcggtatccgctccgagcggctcaagcacctgccggacaaagaatccgcccgccccgttgcccgcgtcgactacgatatgcagccccgccagcggatggtcgtaatcgtcggctttgacaccgaggcggattttttcacacaggctttgcgcatacaggctgatcaggtcgacctttgacaccttggaaacgtcggcctgtctcgccgaaaggacagccgccgtttcaagcaggtcggtgatatcggcgtgctccagtccgccgtccgcgttaaaaaatttaagcccgtttcggttataaggcagatggctggctgtaatcataatggagccgtcaaaacgggtctcaggaaatacgaccgacataaacatggaaggcgtggacgcaagcccgcagtcaaacggctgcgcaccctgtacagccaacccctggagcacctgcgacaaaagcgcaggtgccgaaacgcgcgaatcatgtccaacgccgattttcaattcgctggcaggcttgcccgtgcgctgcgccagccacagcgcaaacgcctgtgcgatcaggttggcggcttccccggtcagattgaccggctggccctcaacgccctccacagcgacgccgcgcacatcgctgccgttttgcagcttcagcatcagttcctttgaaatagacatcgtgatcctcctcaccttcgcctcatcccagcctgtgaccatatccggccgggccggcgcatatgcttttatgacagcagcccgctatatacggtgctgcattgaccgccgagacaaaatcgggcgtgcccgcgcgccgcggccatgcgccgtaataatcgcttaccgcttattatagcaatgatttcccgatttgtcattgattgttttcataaaatcacgtaaaataaatctgtctctattgacaccggccacagcatacctctggtacgattgcatttgataaaggagaatatcatggatctgaccattgtcaactggatcgccacacatctgcgctgcccgcctcttgactttctgatgccggccgtcaccatgcttggggaatatgggtttatctggatcgccgtctgtattttcctgctcgcacgcaaacagacacgccgtatgggctgcgcctgcgcactctcgcttctcattgcgtttgtatgcggagagattgtgctcaaaaacatcgtccagcgcgcgcggccatttacccacctgccggatttgacgctgctcattgcgccgcccggttcattttccttcccatcggggcatacaggctcgtcgttcgcggccgcgtgttcgctgaccctgtccaaccggcgaaacggatggtgggctatcccactggccgtgctgatcgccttttcacggctgtatctctccgtgcattatccaaccgatatcctggcgggcgcgctgcttgggttcttcagcgcgctggctgcccgccggctgctgtacggcggcgcgcggacatagcatctgaaaggacatttattatggaaactatcacaatttatatcggcggcacggcccacaggataccgtatgaagcgccccgaaccctgtccgcttttttggagccgtatggctttcccatgccgtgcggcggcgcgcacacctgcggcaaatgcaaggttgcggcatatggcgcgctctcgccgctgtccgaagccgaaaagcgcctgctgaccgccgacgagcagctttcaaacgtgcgcctcgcctgctgtgcgcaggcgctcggcggctgtactgtccacgcgcgcgcgctcgaaaacgcccggattgaaacggccggcctgtccgcacagcgcagcgacgcctcgccgttcggcacggatggctatgcctttgccgtggatatcggtacgacaacggtggcagcttacctggtcaatctaacgcgtgtccaacccgtggaaacggccagcgcgctcaacgcgcaggcgtcatacggcgcggatgtgatcgcgcgcatcgcgcgctgcgctgaatgcggcgtccgtccgctccaggaggcgatcctcacgcagctcgacggcctgttcacggctctgctgaagcggcgcggccttgatgcgcgcgttgtacgcggcgttgtgctcacaggcaatacaaccatgctgcatcttgcggccgggcttgatcccgcggggatcgcggccgctccctacacgccgcagagcctgttcggcgtgatggaaagcgcgcgcagcctgttcgcagctctgccgccggacgcgcctgtctattttgcgccgtgcgccggcgcgtatatcggcggcgacctgatctgcgcgctgctcgcggccgccccgcaggagaatgaactcttgatggacatcggcacgaacggcgagcttgcgctgattaccaggacgggcatcctctgctgttcgacagcggccgggccggcctttgaaggcgccgggctttcacacggcatggttgcggccgacggcgcgatcacggacgtttccatagcaggggacggcgctgttgtctgcacagtcgccggcggcggcgcggcgcgcggcctgtgcgggacaggcgcgatcagcgcccttgccgcattgctcggctgcaaagcggtcgatgaaaccggcctgctcgacgaacaatatcgcgaatcgtttctgcttatggacggcgtggcgctgacgcaggcggatatccgccagcttcagcttgcgaaagccgccgtcgccgccggcgtcgactccatgctccaggccgccggccttgcgccgtccgatctgcgcgccctgctgctcgcgggcggcttcggcagccgcattgacgtgcggtccgccgccggcatcggcctgattcccccggcctgcgcgccgcgcgcgcgcgcctgcggcaacgcggccggggcgggggcctgcctgatcgcgtcgtcgcagtccgcgctcgacgacgccgaacgtctcgccaagcgcgctcaggtgctcgatctcaccgaaagcgccttcttttccgaccgcttcatcgaacaaatgctgttcccgcttttttgaaacttaccttttttgaaaaaaaggtaagccaaaaaactttaatcggctgcgccgcgaatagtagggcgggtactgcgcatatacaggctgtgctccggcttttttgaaaaaaagcctcggcaaaaaactttagccggctgtgcctatgcccaacggctcgccgcttgcgcggcaaccgccttttgatgggcaattataccatgccgcttcgcggacatggtataatatgcgcagtgcaaacggcaaacgctgcaaagcagcgggctgcgcatgttatgccacagctaaaaccggctttaccggtttcactgccgctttgcggcagttttatgggtatgctaccggtgcaaagcccgacggcgcgccgtatttacacggcggccgtcttttgatgggtaatatttcatatcgcttttcggatatggaatatattgttttttccgccagacacgacgctgccggcgtcggatggggtaaggaggacgcatgaacaatcagaatgaatttgaagatttgatcagaaaattcaagctggatgacgatagcaatgcggagcagaccggctctccccaagagccgcagcgccgtccggcttttaactacgaggatgatcagcgccggtacgctcaggcgcgcagccatgctgcagcagcgactgcgcagcgcccggcggcacagccggccgcaagacctgccgcctcccaggcggcgcctgccggctatcatgcgcagcagccggggacaagaccggcgacggtgtcaggccatacgcagcgccccacgcagccgttgggggcgaggcctgcgccttcaagccatggacagcaccctgcacagccgggcgcgcggatacagcacagcggtacgcagccaggcggccagccgcccggggaccggcggcccgcccgcggcagggacggtgcgtttcgtgtcaatatcaacgacaaggctgcttatgagccgcagccggccggcgctggcggagatccgccgcacggcggccatggcggcgacgattacgacgacggctcgtccggcggtggagcggggcgttggtttaaggcgcttgtcgtgctgttgatcgctttgggtgtttcggtatttctggcgatgtttgccctgcaaagtgcgagcgacctgtttggactcaacaagccggaaggcgaggtcacatttgagctgcccgagaacctgtcgctttcggaaatcgcggctttgctcaaggaggatggggtgattacacagccgctgacattccagctttacgcagggcttaaaaacgatgcggaggatctgctgcctggcacctacacgctcaacacaaatatgggctatgatgagatactgaccgtgtttcgcaccggcacaggcccgcaggaattgacgctgattttctatgagggcatgacgctttcggatattgccaagaagctggagcagtacaatgtttgcggtgaacaggaactatatgattatctgggcagcaacgacttttccgaccgatatgaatttctgaaggatattccggacgacccaaaccgttaccgccgctatgaaggctatttcttcccggatacgtataatttctatgaggatgaggatccgagcatcatcgttcagaagttcttcaaccgtttcgaggaaatggtctatacggacgagctgcgcgctcagatggcaagccagaatatgacgcttgaccaggcggtcacgctcgcctccatcattcaaaaggaggctgcgcagacggccgatatgaagatggtgtcgtctattttccacaagcgtttggacaacccggacgctttcccgcggcttgagtccgacgttacgatcatgtatgtcgaggacgacatcaagccatatctggacgatgcggccaacccggactatcagccgatgtacgatgcatacaatacgtatgtctgtacgggactcccggtcggtccgatctccaatcccggtatggacgccatcaaggcggctatctatccggaggataccgaatactacttcttcctggctgacagagaaggtaagttctattacgctacgaccgctgaagaacatgcggccaatattgaagccgcgggtattgaaggtgtgcacggcattgccatgcccaatgagggcgaatagcgggcggcgttaaaaaggggaatcaccgcttgcaaaccatagagattctgtctccggcgggcgattgggagcggctggaggcggctgtgcgcttcggtgcggatgcagtttacctcggcggcgcgcagtttgatatgcgcgccgcggctgcgggcttcggcccggatgagctttcgcgggcagtcgtatatgcgcatgaaaacgatgtgaacgtttatcttgtctgcaacacgctcgcgacgaacgaggaagccgaccgtttgccggattttctgaagatagcgcacggcgccggcgtcgacgcgctgattgttgccgatatcggcgtgatgatggcggcgcgccgtatcgtgcccaaaatggcgctgcatgtttcgacgcaggccggcgtcgtcaactggcggacggccgaggaactgtaccggctcggcgcttcacgcgtcgtactcgcgcgcgagctgtctttggaagcgatcggcgcgatccgtgcgcgcacctcgccggagctggagcttgaggcgtttgtgcatggggcgatgtgtatgtcggtgtccggccggtgcctgctcagcagctacctgaccggccgcgacgccaaccggggcgaatgcgcccagccgtgccgctggagttaccggcttgtggaggaaaagcggcccggccaatattttccgattgtagaggatgcgcacggcagttatatcctcaacgccgatgatctttgcatgatcggtcatctcgaccgtctggcagaggcgggcgtgacctcgtttaagatcgagggccgcgcgaagtcggcctattatacggcgtgcgtcacagcggcctaccgcgctgcattggacgcgtatcttgccgcacccggcgcatacagcccgccttcctgggcgcttgacgaagtggataaggtaagccatcgcaattattccacaggcttttacttcgggacgccgggccagaattgtgagacaaacggctatgtgcgcggatgggatgtgatcgcttctgtagagggatgggccggcggccggttgactgtgcaggaacgaaacgcgttttcacgcggggaacaggccgagctgcttgttccgcggcaggcgccgcgtccgctgcacatcgaggaaatttttgatgttgagctgggcgcgcctgtggagcgcgcctgtcacccgatgcgccggtatgagctgccgtgcgcaggccctgtgccgcccggctccatgctgcgccgccgcgcggcacaggggtgaaggcgtatgataaccggcagctttcagcgcgccgtttgacgatgaatagataaagaggaaaggttgaacgatatgtccggacattccaaatgggcgaatatcaaacgcaaaaaggagaaaacagacggccagcgcgccaaaatatttacaaaaattggccgtgagattactgtcgcggcgcgcgagggaggtcctgatccgaacaacaacagccgtctggcaacgctgatcgcaaaggcgaaggccaacaatgtgccgaacgacaacattgaacgtttgctcaagaaagccggagagggcaaggaggactacgaggagattacatacgaagggtacggcccttcgggtgttgcgctcattgtggaaaccctgaccgacaaccgcaaccgcacagcgggcgatctgcgccattattttgataagtgcgggggcaatctggggcagacgggcagcgtgtcgtttttatttgagcggcgcggtatgatctacatcgaaaacgaggataacgggatcgatgaggaaaaggtcatggacgactgcttcgaggtgggcgcgactgattttaactatgaggatggcatgatcacgatcacgaccgagccgaatgacgtggccaaagtcgcggctgctttgcaggagaaggggtacacgtacgattccgccgaggcggagtatatcccgatgaccaagtcgaagatcgacgacgaggcgctgcttcagaaaatggaaaagctgctcgatctgcttgaggagaacgacgacgtacagaatgtctatcacaactgggatatgcccgaggagccggatgaggattaaggacatttccttgctttgaaaaggaccttggcaaaaaatgacgcctggctgcgccgcggacagcaaagcggccgccgggcggagaataccggggaaattcaaaaaagattaagggctgtttaaaaaatcaaaattcccgtcttttgctgcaaacagcggcggatactgtgttaaaaagtcctggaatccgaaaggattcctgcttttttgccttgcattttcctgctgcttgcgaaaaattcggcaattcttctattttcaaacaagccctaagcgcgccgcggaatttttattccgcggcgcgctttttttgtgcgcacagtatgcgccgccttcctgttggtttgccgtgaaaggcggcgcaagctgtcggaatgcaaaggtatgggtcgaccgattccatctgcattccttgatttggcaaataaaagtgcttgcaatttgggtgtgggacaagtataataaagaagtaaaagtggtgaaaagtggttaagagtggagaatactccattgaagtggtgaaaattttcccagcgggggtgaagggatgctgacgggccaatatgcgcataacctcgacgccaagggccgtgtcaacttcccggcacgcttgcgcgaggagcttggcgatcggttcgtcgtgacccgcggactggataactgcctgtttgtctattcaatggaggaatgggagcgtcttgcggccaagctgcgcgagctgcccatcagcaaatccgcgccgctcaaccgctttttcttcgcgggagcagccgaggtggaaccggaccggcagggacgtgtcgtgcttccggcgcatctgcgcgaatatgcggggcttgaacgcgatgtaacgatcgcgggcgtctccaaccgcgctgagatttgggacacggcgcgttgggaggcgcagaacgagctgcttacatcagaggccatcgccggtgcgatggacgatttggggttctagcctatggacgaactgcatttttcccatgtgcccgtgctgcttgacgcctgtctggaggggctgaatatccgcccggacggcatttatgtcgacggcacggccggcggcgcggggcattcgcgcgccatcgcagagcgtttggacggcgggcggctgatcgcgcttgacaaggatcccgatgctgtggcggtggcgtccagccggcttgcgccgtttggctgcgcaacggttgtacagagcgatttttcagaactgtgtacggtattggacaagctgggaatcgaggcggtcgacggtattctgctcgatttgggcgtgtcgtcctaccagcttgacacgccggagcgtggattttcctacgcgcatgacgcgccgctcgacatgcgtatgacaaagacgggactcagtgcccgcgacgtggtcaacacctacagcttcaaggatttgtgccgcgtgttccgcgattacggcgaagaaaagtttgcgccggcaatcgcaaaaaatattttgaaatccaggacgcagcgcccaattgcaacaacagcagaattggcggcaattattggcgcgtcgattcccgcaagggcacggcgcgaagggggcaaccctgcaaagcgcgtctttcaagcgattcgcattgaggtgaacggggaactctccagcctgtctgtttttctcggcgaagcgtttgaaaggctccgcatcggcggacgcatggcaatcatcaccttccactcgcttgaggaccgtatggtcaaacagcgatttgcggcgctttgcaggggatgtacctgccctcctgatttcccggtctgcatctgcggcaatcagccgcgcgggcggcttttaaaccgcaagccgattgaagccggggagcgggagcttgccgccaacagcagaagcaaaagcgcgaagctgcgcgtcattgaaaaattataaagcttcaaaccgcccgcgcacacgggcggaagggcgtgccaacagaaaaaatcaggcgcgtccaataaagacatagagaaagagacagcagagagactggatgaaaggagtcggccatgcaggtacgttacgcatcaaattcaggcgccgcatatgatctgaaccggtttggcgcgcacagacagcgcggcagaaaaccgaatctgacgattgcggcaccgtcggcaaaggcccgcgcgcgcgcgggaatggcggccgcattcaagacggcggcggcgcttgcgctggtggccgcgtttgtggtgacaatgctttacagccgtgcggtgctgacagagctgaaccaacagattgcggcacagacaaacgcgctggcggacgcacagagtgaaaacacacgcttgtccgcgcagcttgacgcaaaggtttcgctgcgcaatgtggaggaatacgccacacaggcgcttggcatggtgtcgattgacaaaagccagattacatatgttgacttgagtgaaggagacaagattgagctgacgatggattccccccggttgtcgctgatagaccgcatccgtgttgcaatcagcaacgcaaaaaatccggaggactaaaacaggcgccgcgccaataaatatatgaatggcatgaaaagcaagaaggatgcgaaggggcaataccccgctatgcttcttgctttcctcgcattttggcccggattcgacggtaaacgccgcgtttcgtatcggtgtccatgcggcggacggcgcaacttttgcaaaggaacggtataaaagaatggcgaagtctccaacctaccatatgaaaagccgtatggtcgtcgtgcttgtcgcgatgatcgtgctcggtttctgtgtcgtgctgcatcagttgtttgtgctccagattgtggagggcgagtcgatgcaggcgcgcgcgctccaacatcagctgcgcacaacgcgcatcggcgccaaacgcggcgtcatctacgacacaaacggcgaaaagctcgctgtcagcgccgacgtttcgtcggtctgcattgcgccaaaattggctgatacgcccgaaaaagaggaggccgtcatcgatctgctggcggaatatatcggcgcggataaggaaactgtcaaaaagaagctggagcgcaaaggatcctattacgaggtcgtcaaggagaaggtcgaggacgaccaggcggacgcgttgatggcagcggtcggcgaaaacggattgacgggcgtcattttcctcgaggaagacacccgccgttattatccatacgggaatttcgcttcggccgtgctcggttttgccaacaatgacaaccacggtgcgtatgggcttgaggcgtattatgaaaagacgctcgccgggacgccgggacgcgttgtgtcgatgaaaaacggcgcgggcgttgatatggatatgcagtatgtccagcggtatgaggcgcaggacggcaattcgcttgtgctgacgatcgacgagacaattcagcattaccttgagaaaaaccttgaaatcgcgctgtcagagcatcgtgtgcgcaaccgtgtgaccggcattgtgatggatccaaagacaggcgcggtgctggcgatggcctccaagccggatttcgatccaaacaacccgtatgacatcatcgacgaaaacgtcgctaaaaagcttgaggaggagttggccgctctgccgcaggacgactcggaggaatcgcagaaggcacgccagcaggcccggatggagacgctttactcgctgtggcgcaactatgcgatttccgatccatatgagcctggctcggtctttaaaattgtgacggcggccggggctttggaatgcggcgcagtgacgacgcagtcgggctttaactgcctgggctatgtgaccgtcaacggcacacagtatcactgctggtactggaccggacaccactccggccatggggcgcaggatttgacgcatgctgtgatgaattcctgcaatccggcgttcatcgatatcggacagcgaatgggcgcgcagaatttcgcggaaaactttgcaaattttggcctgacacagccgaccggaatcgatatgccgggcgaggctgggagtatttaccatggaacctattccgtcaacgatctggcgtcctcgtcgttcggccagacattcaaggtcacgccgattcaaatgatcacagccgcctgtgcggctatcaacggcgggcagcttatgcagccgtatgtcgtcaagcagatcatcgacagcgagggcaacgttatttcaaatacggagccggttgtcaaacggcaggtcgtttccaaggaggtttccgaggaaatggcgctgatacttgaacaggttgtcggcggaggcggatccggtaagcaggccgctattcccggctaccgtgtcggcggaaaaacgggcacgtccgaacagctcgacgaccgcaaggaggatggacgtatcccgaataccctgtcgtttttcggcttcgcgccagtcgacgatccgcaggtggcgtgccttgtgctgctcgacgaccccgatatttacaacgccttcggttcaaccgtcgcggcgccgattgtcggctctattttggcggagacgctgccgtatatgggcatcgagccgcagtacaccgaggaggagcttgaaaacaccgcgacgcaggcgccttatctgctcaattatgatctgcacgaggcggaatatgaggtgcgccgccgcggactgaagttccgtgtgatcggcaatggagcgaaggtgctcaaacaggtcccggctgcgggtgaaatgatcccgcaggacggcgtcattgtgctgtataccgaggaggaaggcgcgggagaattgattccggtgcctgatgtcgtcggaaagacgctccaggaagcaaaccagtcgatcgtcggctccgggctgcagatcagcgtccagggcgaacagatcgaaggcacgcacagcgttgtttcagcacagtcgcctgacgccggcgagatggtggaggcgggcgccgtggtgacagtcgaatgcgtagcggcggagccgcccgcgcagccatagcgggcatgtttttacatctcagtatgtccgcgcgccggttggcgcgcggatgcgaccgaagggggaatctttatgcgcctttacgaattgctcgacgggcttgacgctgcccgcccggacagggactgtgaaatcaccggcgtcacctccgattcgcggcaggtggagcctgggacgctgtttgtttgtatccgcggcacgcgcgccgacgggcatgattacgcggtaaaggccgcagaagccggcgcggccgccatcctgtgtgaacgcgccattggactggaaaacgagattgtctgccgcgatacgcattacgcctacggcatcgtctgcggcaactggtacggcaatcctgcgcgccgtctgcgtctggtgggcgtgaccggcaccaacgggaaaacgaccgtcagctatatggtcaaacacatcctggagtcggctggtcatcagaccgggctgatcggaaccattcacaatgagatcggagacatcacgctgcccgccaagcatacgacgcccgatccgctcgcgctgcatggcatgctcgcgcgcatggcggacgccggctgcgaatatgtcgtcatggagtgctcgtcgcacgcgctcgatcagcagcgattggcgggactgcgctttgcaagcgttgggtttacaaatctgacgcaggaccatctcgattatcacggcgatatggagagctattaccatgcgaaaaaaaagctcttttcaatgtgcgatgccgccgcggtcaacatagacgacgcttatggcgagcgcctggcggcggaggtgcggcacatctgtccggtgacgacgttttccaccgtttcggacgcggcggattttaccgcgaaggatatccgccccgcgcccgattcaagccgctttatgattgtcggcaagggcgcgatcgcacgtgtgcgcctgccgatcccgggggatttttcggttgcgaacgcaatgacggcggccgtcatgtgtatggcgctcggactgacgctcgaacaggcggcgcagggcttaaacacctgtcagggggttgtgggccgcatcgaggtgctgccgacagggacggattatgtcgtgatccgtgattacgcgcacagccccgacgggctggaaaagatcattacaacgatgaagaaattcgcgcgcgggcgcgttgtaacgctgtttggctgcgctggcaaccgtgaccgtacaaagcgaaaaaagatggctgaaattgtggcgcgcctgtccgactttgtgattctcacatcggataacccgcgcgatgaggacgagatgcagatcatcgaggatgcaaagcccggcctgctggagcatccggacacgccgtatgaaatcatcccggaccgctatgcggcgatcgaatgggcgctcggccatgcaaaaaaggacgatgtgctgatcctggccggaaaaggccatgaggattatcaggtgctgcacggcgagacgatctgttttgacgagcggcagattgtgctggaactgctggaaaagaagaaaggatcgtgaatcgtggaacgcatgacgctaaaggaaattgccgcggcgatcggcgcggacgggtcatttgagggcgcggtcggctgcgtctccaccgactcgcgcgccctgccgccgggctgcctgtttgtggcgcttgagggcgagcggttcgacgggcacgattatattacggcggcgctgcgcagcggggccgcgtgcgccgtcgcgcatgaacggcgcgattacggcgcggggcctgtcatgtatgtaaaaaatacgcagcgcgcgctgatggatatcgcgcgcgcctatcgggcgcgttttgacatccattgcatcggcgtcacgggcagcgttggaaagacgacgacaaaggatatgatcgcggcggctgtatccgccggattccagacgcttaaaacagagggcaatctcaacaacgaaatcggcctgcccaaaacgctgctcggtctgatgcgcggccacgaggcggccgtcgttgagatggggatgcagggctttggtgagatcgctgctctggccgatgtggcgcgtccgacgctcggcgttatcaccaatatcggcgtcagccatatcgaacagcttggaagccgtgaaaatatcatgaaggcgaagctggagctggccgatgctctgccggacggcgcgccgctgtttttatgcggggacgacgatctgcttaaaaaggtgtcggttccgcgcctggacgtgcgcttttacggtgtcgaaaatcccgcgtgcgcgctgcgcgcggcggatatccgcgaggcgggagcgcagacggcgtttacgctgcgctatcccggcggccgggtggacgtgaccatcccgtgcatcgggctgcacaatgtgcgcaacgccgccgcggcctgcggcgtcgggatggcgctgggcatcccggcggaaaaatgcgcggccgcgctcgcggattatgtgccgtccggcatgcgccagcgcgtggtccactggggcagcgtgacggttgtggaggactgctacaacgcctcgcccgattcgatgcgcgcggcgcttacgacgctttcggccatgcggtgcgccggccggcgcatcgcggtgctcggcggcatgctggaattgggcgcatactcgcaggccgcacaccgtgaggtcgggcaggccgccgccggggcgggcgtcgatttgctgcttgcatatggaggcgacgcctgctattatagtcagggcgcgaaggaaggcggcgtcgagtccgaaaccttcagcgacaaggcggatttgctcgcgcggctgcgcggcgcgctcggaccgggcgatatcgtctgggtaaagggcagccggggaatgcgtatggaggaagtcctccaaggactgtataagggagagcgcattgatgaataatagcacagtgttgattttgacgactttgatttcctttgtaatcagcgcgtcgcttgggatcgttctgattccgtttctgcacaagatccatttcgggcagacgatcctggatatcggcccggcatggcacaagaaaaaacagggcacgccgatcatgggcgggtttatgtttatcatctcgattccaatcgctgtgatcaccggctatatgctgctgagagcttatcagccgcagcttttgtccgcgcagggcggcgtcaagctgttcgatagctggattatggcgatgggatttggcgcgatcggattcatggacgactatatcaaggttgtcaaaaagcagaacctggggcttaccgcgcgccagaagtatatgatgcaactggtcattgcggcaatctacctggtgatgctccatatggcgggcgaccgctcaacctcggtggccatcccgtttttcgggcgcatcgagctcgggccgctctactatgtgttcgcgctggttgtgattacagggtttgtcaatgcggtcaacctgacagacggcgtcgacgggctttcctcgtcggtgacgtttgtaaacgctttggcgatgctcgttgtgaccggtatcctcggctttgccgaggcgggcctggcgtctgcggcgctggccggcggactgctcggctatctgatctggaacttttatccggccaaggtgttcatgggcgacacaggttcgctgtttatgggcggcatggtcgtggggcttgcgtttcaggtcggactgccgctgctgcttgttctgacgggcgtcatctactggtgcgaggcgctgtctgtcatcttgcaggtcatcagctttaaaacgacaggcaagcgcatctttaagatgagtccgatccaccatcactttgaattgagcggctggagcgaggtgcgcatcgtcgggacctttgcggcagtgggactgatcggcggcgcgcttggcgtttggtcggtgctgctgctgtaacggccggcagggatatttgaaagggggcgtgccgatggacgcggcacattcggcgggaaaggcccgcaaaaaacgcatccgtgcggaaagaaacggcgtcgacctgacatttttgtttctggtgctgatcctgctttcgatcggcctgatcatgatgttttccgcaagctacgcctcctcctattacgagacgggcgacagtttttattacattaagcgtcagcttttgttcgctgtggtcggcgttgtcatgatgctggccatcgcgaacatcgactaccacatcctgcaccgctttgcattcctgatttacgcgggcacgctgtttttgcttgtcgtcgtgttgatcgtgccgacgcgcgaggacgccaagcggtggatcaatctgggctttacaactttccagccgtcggagcttgccaagtttgcgattgtactgatcttcgcgcatctgatatcggtcaactatgagcgcatgaaaaacccgcgctacggcgtttggccgtttcttgtgctgctcggcgtcgtcgtaatgctgatgctgctcgagccgcacctgtccggcaccatcctgatcgtttcgatcggcgttgtgatgatgtttgtcggcggtacggatttaaaatggttcatgctcggcggcgtgctcatcggtgtggcgatcatcgcggcggttttgataccaggcgtcgttccatatgccatggaccgcctccaatattggattgacccatggagcgacccgcagaacaagggctttcagactatccagtcgctttatgcgatcggttcgggcggcctgatgggcgtgggtatcggcaactcccgtcaaaagcacctgtacctgccggagccgcacaatgactttgtattctccgtcgtctgcgaggagcttggcttcatcggcgcgacactgattatcttgttgttcgtgctgctgatctggcgcggctacgtcatcgcgatgcgctgccgcgaccggttcggctcgatgcttgccgttgggctgacaacacaggtgggcgtgcagacggtcttaaatatcgccgttgtgagcaatacgatcccgaacacgggcatcagcctgccgtttttctcctatggaggcacggcgcttgtcatgctgctgtgtgaaatgggcgttatcctgtctgtttcacgtcagacgaatatcgaaaaggagtagaaccctgcgcgtctgctccgaagggagggtccgctgtgaaaatcctgtttgcctgcggcggcacggcggggcatatcaacccggcgcttgctgtggccggatatatccatgcgaggcatcctgaaacggaaatcctgtttgcggggaatcccaaggggatggaggcgcggctcgtaccgcaggcgggctatgcgttcgcgccgatcgagatcatgggctttcagcgaaagctgagttggtttaatatccgctacaatctacgctccatcggctgcctgatgcgttcctggaaacgcgccaggcagatcatccgcacgtttggtccggatgtgatcgtcggtacgggcggttatgtcagcggaccggtgctccgcgagggcagtaagcttggcgtcaaaacgctcacgcatgagtcgaacgcttttccgggcgtgacgacaaagcttctggcacgcacggccgataaggtgctcatttccgttgaggaggcgcggcgctttttgccatccggacgcgattatatcgtcagcggcaaccccgtgcgcgaacagatcatatttgctgaccgtgaaaaggcgcgtgcgcgcctgggaatgggcggccgaatctgcatagtgtcgtttggcggcagcctcggcgcgcgccgaatcaacgaggcggtcgcgggtttgatggcctgggagcaggcgcgcggcggcatttatcacatccacgcgacaggctcctatgaaaaggaccggtttccacagcagctcacggcggctggagtcgatccgaaggcgcccggattggatatcaggacctacatcgacgatatgcccgactgccttgcggcggccgatcttgttatctcgcgcgcgggcgcgatgaccctcagtgagctggaggccagcggcacggcctgtgtgttgatcccgtccccgaatgtggctgaaaaccaccagtatcacaacgccagggtgctggaggagcgcggcgctgccgttgtcattgaggaaaaaaacctgtcgccggagcttttgcgttccacagtcgcaggtctgtgcgaggagccgcagacgctgtgccgtttgggaaaaaacgcgcagaagatggcggtgcttgacgccaatgaacgcatttacagagaaattatatctttgatcgggacataagacatccgccctttatcaccacccgtgcccgagcggcataggatggttttgcaagggcttcccgtacccttgcgaaaagcgaaagggtgcgtgaagatggctgaatttatcatcgaagggaagcgccggctggaagggagtctcgccgtacatggggcgaaaaactccgcgcttccgattttggcggccacactgctgcctggagactgtgtgatacataattgtccccggcttaccgacgtcgatgcggcctgtaacattctgcggcatctcggatccgagacagagcgcgtcggcacaagcattcatgtcggcgcaggcaaaggctgctgctgttgtattccggatgagttgatgcgccgtatgcgttcgtcaatcgtctttctcggcgcgattgttgcaaaatgcggccgcgcgcgtatttccatgcccggcggctgtgaattgggaccgcgtccgatcgacctgcatctggccgctcttgaaaagcttggggtgacgatcgaggaggatcacggttatttggagtgtaccgtccgcgaccgtctgcgcggcacgcggatcgccctgccgttcccgagcgtcggcgcgacggaaaatatcatgatcgccgccacactggcccagggggaaactgtgatcaaaaatgcggcgcgtgaaccggagatcagcgatctggccgcatttctcaatgcctgcggcgcgcgcgtgtgcatcacagcggatggagatttgcacattaccggagtcaaagagctgcatgcggccgagcaccgggtgattccggaccgcatcgcggcggcgacttacctttcggccgccgccgcgacaggcggggatgtggaactgaccgacgtctgcaccgagcatctggcggcggtgctgccgtgctttgaggagatgggctgcgcgctgcatgtcgcgcccgataaggtgcacctatgcgcgccaaagcgtctgcatccgcttcgttctgtgcgcacgatgccctatcctggcttcccgactgatgcgcagtcgccgctgatggcggcagcctgcctggccgacggaaacagtgtttttattgaaaatatctttgaaagccgctataagcatgtcccggagcttgcgcgcatgggtgcggatatcaaggtggagggacgtgtcgcgcttgtgcagggcgtatcgaagctgcacagcgccgatgtgcgctgcaccgacctgcgcggcggcgcggcgatcgccattgcggcgctttcggcagatggtgtgacacgattgagcgatattgggcatattgaccgcggatatgaacattttgagaaaaaccttgaaaaaatcggcgccaaaatccggagaggggcataacttatttgcctaaacgtatatgacgtgttataataaccgcagagcggttattataacatttatagccaggacgatatgcgggcgcggtccgctgctgtctgtatggccaatgatttcttaccagaaagcaaggatcacggaatcggctgcgcggccgccgcttttttagcggcgcggcgactgggcggataccgcgctgcggtatccgccaacaatcctgtttgcgccaaagcggagagggacctatatataaacggtgggtcgacaaaatcgccgtgaaatcgcaactgtttggcggtatactgtcatctggcgggtctgttgacaaagccgtattttgaaagaccaagccgcttgcttccagcgcctttgacaaattaactgccgggccgcagcggcttgttcggactttttgttcaggaactgttggagagaagcttccgggttttcataaacagcaggggcacaaaggacagaaaacacaggaatcgatatggattccttttgatgcttattcatacagcgggcatcgctgaatgcaaaaaaagaacagtgtttttgactttaagcagcccttaatccgctgaaagacgaccgattttggcggttccttgcttgtcgacagcccctggcggcacatattcagcggtgcgcgggagccagatcttggaggacgcgcaatgaagcaaaagatcatatcctttggcggcccggcccggcgtgcttcgccggaccgcaacagagccgccgcagcggtcaacgcgcgccggcggcgcaggcggaccggccgccggaccctgcattacatactgatattgctggcagcagcggcaatcatgatgcttttatccctgacggtgttgtttcgcatcgagacgatcgaggtcacgggttcgacacggtatgctgcaggcgagctgcttgacgcgtcgggcgtacaggttggggacaacctgtttcgcgtcagcgcgcgcggggtggaaaagcgtttgaccgaacaattcccatatgtacagtccgtaaagctgcgccgtattctgccggccaagctggtcgttgaaatcactcaggccaagccgctgggcgcagtggaaacggcgggcggttatgtcgttatcggccgcgacggccgtgtgctggaaatcggcgcgcaggctgtacccgacggcgtcatgattatttcaggtatgtacctctaccagccgcaggttgggcgtgtgctcggtcagggatattcggaggatgaacagaagcaggcggcgctcgaggaggaagctttcaagatgctgtccctgctcagtgacgcgattgcccagacggagttcgaaaaaattacgtttgttgattttacggacaggcttaatatgctgcttgtttatgacaaccgtgtgattttggagcttgggacagaggcggagctgccatataagctgcgctttgccaaaaatgtgcttgaatcggagcttgaaagctcctttactggaacgcttgacgtgtcgctcgctccgaccaagaagaccgtttacgcgctgccgggcgatatcacggcagagcttgagaaacgccgcgcggctgttgccgcacagcaggaggaaccggacagcggcgctgaatccgcttcgtccgagccggttgatccaagcttggctgtcgtgccaggaacggcgcccgcctcctcgcagacggaaaacgcttcttctggtgcggatgaacaaagccaggcttcatcggctgttgatgattttcttgcagtgattccggggacagccccttccgccgtggaggagccggcagattcgtcgtcttttgcatcgaaaagcgtggagtaagctttttgtgaaaagatttgcacagagctggcatagggccggaggcgtttggtgaaaacaatcagggaaatattacattttgccttcctggggtggattgctattgatttgctccggtgaatctggtaaaatgatatttaatagtacatgtgcggtataggcccgtttgatgagggacagcacccgccggatagtattacaatgggggaacagcgatgttaatgaacttcgacatggcgaacgacgatgcggagaatgtcgtatcgatcaaggtggtcggcgtcggcggaggcggcggaaacgccatcaatcggatggtgcagtccggtatgcggagcgtggaatttatttccattaataccgataatcaggcgctgatccgctcgcaggctacatataagcttcacatcggggacaagctcacgcgcggcaagggcgcgggcgggaatcccgaaaaaggtcagcgcgccgccgaagaaagcagggacgagatcgctgcggccctcaagggcacggatatggtctttattacagcgggcatgggcggcggtacaggcacaggcggcgccccggtcgttgccgaggtcgcgcacgaaatggggatactcaccgtcggcattgttaccaaaccgtttttgtttgaaggcaagcgccgcatggatcaggcagagatgggcgtcaccgcgctgcgtgagcatgtggacgcgctgctcgtcattccgaacgagcgcctcaagctgatttccgaggaaaaaattacgcttcaaaacgctttttccgcagcggacgacgtgctcaagcagggtgtacagagcatctcggatcttgtgaacatccccggtgttgtcaaccttgacttcgccgatgtcactgcgattatgaaggacgccggctatgcgcatatgggcgtcggcagcgcatccggcaaggataaggcgcgggccgccgctgaaaaggcgatttcttcgccgcttctggaaacctctatcaacggtgcgaagggcgtgattgtcaatatcacggcgtcgcctgatatcgatctggatgatatcgacattgcttcgtcgatgatccatgacgcggcgcaccctgatgtcaacctgatctggggcgctacgttcgacgagacgcttcaggacgaaatgcgcattacagtaatcgcaaccggctttgacaacgataaaaactttatccttcccaattataattttggcggacgctcggccgcaacggggcaaaaaggtgcggctcccgccgcacagacacagccggagccggaaaccggcagcgatgacgatgataatttcttcgacattctgtcaatattcaacaacaagaaaaactgatcgcaaaagagagtattgccagaaacggtgatgctctctctttttgtaaaatccatgtaaacgtcccgcggcgcgggcacggaaggggaatggacagatgaacgaacagaacaggccgatcttatatcacaaccgggaactgagctggctcaaatttaaccagcgtgtgcttgagcaggccgatgaggcgtcgatcccgctgctggaacgattgaaattcatatcgatttttggcagcaatcttgatgaatttttcatgatccgcgtcggtaccctgacggacgcgtcgatgatcgagccggatacagccgataataaaagcggcatgagtcccgcagagcagttggaagcaatctttacacagacgcgcgcactaatcgcacgcaaggatgagacataccggcggctggccacggatatggcgcgcgaaggtatccggcatctcgatattgacgcgctcgatgacgagcaaacggcttttctggaggagtactttcgcacagaggtcatgccgatgctctcgcctcagatcatcgataagcaccatccgttcccgtttttgaaaaataaggagacgtatatctgcacgcagctccagacaaagggcgagtttgtcaagctggcgatcatcccggtttccgggttcgaccgcattgtatacctgccgtttgacatcaataaattcgtgctgctggaggagttggtgctcaaatactgcgaacacatttttccaggatatgtcgttgtggccaagacgattttccgggtgacgcgaaacgcggatatcaatgtcgacgaggcgctttacgaccatgatatggattaccgcagcgtcatggaggagatggtcaagagccgccgcaagctgatgccggttcgcctggagtttcaaggcggcgccaacgacgcggtaatcgaacagctttgccgcaagctggagctttcacgcgaccgcgtattttttaacgtgacgccgctcgatatgtcgttcggctttgcgttgtgcagcaagatggaacggcgcgggctgaagcagtttttctatccttcgctgatcccgcaggacagcgagatggtgcagcccggcaagccgctgattccgcagattgaggaccacgatattatactgtcgtatccgtttgaaagcatgaagccgttcatcgcgctgctgctcgaggcggccgacgacccggcggtcctgtcgatcaagatgacgctgtaccgcgtcgcgcgcgaaagccagatcgtggccgcgctgatcaaagccgcggaaaacggcaaggaggtccatgtcgtcgtcgagctgcgcgcacgctttgatgaggaaaacaatattatctggtccaagcggcttgaggaggccggcgtcaacgtcgtctatggccttggccagtacaaggtgcattccaagctgctggtcattacgcggcgcgtcggcgacaagacgagctttatcacgcaggtaggcacgggcaactacaacgagagcaccgcgcgccagtatacggacttgagcctgatgacagccaaccgtgaattcggcgaggacggcctgcgtatctttatggggattttgacggataatcccgccgacggcacaaagcatctgattgccgccccgattacaatgaagccggcgatgctgcgctatatcgaccgtgaaatccgctttgccaatgagggcgagccggcggcgattaccatcaagatcaattcgctgacggacaaggacctgatcgataagctgatcgaagcgtcgatggccggcgtcaagatccgaatggtcatccgcggcatctgctgtctgcgcgtcggcgtgcccggttatacggacaacatcgaggtcgtgagcattgtcggccgttttttggagcattcgcgcgtctatgtgttcggcacgccggagcgatgccggatgtatatttcctcggccgattttatgacgcgaaatatggaacggcgcgtcgaggtggccgccccgatctacgacgagacaatccgagcgcgcatcctgcggcttgtggacctggaattttccgacaatgtcaaggggcgccgtctgctggaaaacggcgagtacacgcctgttaagaatcaaaagccgcccacggacagccagatcgatctgtataaggccgcgtacatgcgcgccgaaaatgcggcggcgcgccgcgcggcgcagccggtaacgccgcgtccgcggacggcggacgggcagaaaaagcgccagcccacgctgatcgagcggctgcgcggcctgtttggaaagtgagggctcagatgctttattcgatccgcccggtgcgtccgcaggacgcgccggacatcaacgccatccgctcgatgcgcgggacaatggaaaatgtgcttgggatgccctcgaaccgtgacgagcaagcggagcgttttctgacgtcgctggggagtgacgatcactattttgtcgcggccgccatgcttgaggacggtacggagcaggtgatcggttcagtcaacctgcacgtggaaagcggacgtatgcgccactgcggcggaatcgggctgatggtgcatcccgacttccagggccgcggcattggtcgggcgctgcttgacgcggcgctcgacattgccgacaactggctgatgctgaagcgtgtggagctgaccgtctttacggacaatgcgcgcgccgtcgcgctgtatcagtcggccggtttcgaggtcgaagggaccaggcgcatgggcgcgatccgcggcggcgcttatgccgacgaatactatatggggcgtatccgtcagagctgcacgcgggaggaaaaaacgcaggacgcttgacaaactgcgcataaaacggttaaactggagaatgattgatagaaaacccccgcgtccggacaatgggcgcgggggcaatgtttgacgcgatgcgtccgcagactatggcagtgacggaggcagacagatgccaaaaaaaacgactacggattatggaaacgacagtatttcatcgctcaagggcgccgaccgcgtgcgcaaacgcccgggcgttatattcggctcggacgggcttgagggatgccagcacgctatgtttgaaatcctctcaaattccatcgacgaagcgcgcgagggtcatggaaacaaaatcctgattacgcgttaccgcgaccagtccattgagatcgaggactttggccgcggaattccggtcgattttaaccagcgcgagggccggtacaattgggagctggtgttctgcgagctgtatgccggcggcaaataccagacgaatgagggcgaaagctacgaatactcgctcggactcaacggtctgggcctttgcgcgacacagtatgcatccgaatatatggatgtggagatttaccgcgacggtatgaagtatacgctccattttgaacacggtgaaaatgtggggggactgcataaggaggagacgcgccgcagacagaccgggtcaaaaatccggtggaagcccgatttgcaggtatttaccgagatcgatatcccgcttgaattttatatggacacgatcaagcgccaggcggtcgtcaacgacggcgtgacgtttatcctgaaaaacgagacggattcgggctttgaggagacgacgttccagtatgaaaacggcatcgtcgactatgtgacggagcttgccggggaggagccgctcacgccggtccaattctggaaggccgagcggcgcgggcgcgaccgcgaggacaaaccggaatataaggtgcggctgtcggttgcgttctgcttttccaaccgggtcaagcggtgcgaatattatcacaattcaagctggctggaatacggcggttcgccggagcgcgccgtcaagctcgcgtttgtttatatgatcgacggctatattaaaaacgccggcaagtaccagaagggcgagagcaagatcaccttcgccgatgttgaggattgcctggtgcttgtctcgtcgagcttttcgacgcagacttcgtatgagaaccagacgaaaaaggcgattacaaacaaattcatctatgaggcgatgaacgatttcctgcgccatcaaatggaggtttatttcctcgaaaatccggacgaggcggcccgcatcgccgagcaggtgctcatcaacaagcgcagccgtgaaaatgcggagcgcacgcggctcaacctgaaaaagaagctggccggaacggtcgacatgtccaaccgtgtgcagaaatttgtggactgccgcacaaaggacgtgtcgcgccgtgagatctatattgtggagggcgacagcgcgctcggctcctgcaagctcggccgcgacagcgaattccaggcgatcatcccggtgcgcggaaaaatcctcaactgcctgaaagcggaatacgataagatatttaaaaacgacatcatcgtcgatatctttaaggtgctcggctgcggcgtcgaggtcacgacaaaatcaaacaaggatttttcctcgtttgatctggatgggctgcggtggaacaaaattgtcatctgcaccgatgcggacgtcgatgggttccagatccgcacgctgattttgacgatgctgttccgcctggcgccgacgctcattgagcgcgggcgcgtctatatcgcggaatcgccgctgtatgagatcacaacgaaggacaagacgtatttcgcctataccgagcaggaaaaagcgcacgcgctcgcccagatcggcgacgccaaatatacgatccagcgttcaaagggacttggcgaaaacgagccggatatgatgtggctgacgacgatgaacccggagacgcgccgtctgatccgtgtcacgccgtcgcaggcgcaggagacgtccgacatgttcgatctgctgctcggcgacaacctggccgggcgtaaagaatttatcgccgaaaacggaagccgctatcttgagatggcggacatttcgtaagccgcggccatttaattgaggtgcagacatggcagcaaaacgccaaaagaaagaactgaaaaaaaatgtgaacacgtcggcggtcattgaaaacgccggcgtgctgatcgagcagccgattgtatcgacgcttgaggaaaattatatgccgtatgcgatgagcgtcatcgtttcgcgcgccatcccggagatcgacggctttaagccctcccaccgcaagctgctgtacacgatgtataagatgggcctgcttaccggagcgcgcaccaagtccgccaacgtcgtcggcgcgacgatgaagctcaatccccacggcgatgcggcgatttatgagacgcttgtgcgcctgtcccgcggctgcgaggcgcttttgcatccgtatgtcgacagcaagggcaatttcggcaaggcgtacagccgcgatatggcctacgcagcctcgcgctacacggaggtcaagctcgacccgattgcgaacgagctgttccgcgacattgacgaggacacggtcgatatggtcgataactacgacaacacgatgaaggaacccacgctgtttccggtgacgttcccatccgtacttgtcaactccaacattgggatcgccgtcggcatggccagctcaatctgtccgtttaatctcgcggaggtctgcgagacgacgatcgcggcgctcaaaaatccggagcatgacctgcttgagacgctgcacgcgcccgatttcccgggcggcggctatatcgtctatgacgagcaggcgcttcgccggatctacgacacagggcgcggcggtatccgtgtgcgcgcgcgctacacgtatgaccgcgccaacaactgtatcgacgttacggaaatcccgccgactgcaaccgtcgaagccattatggacaaggtggtcgacctggtgaaagcgggcaagatccgcgagatcgcggatatgcgcgacgagacggatttgaacgggctgaaactgacttttgatctcaagcggggcgtcgaccccgaccgcctgatgcagcggctctttaagctgacgccgctggaggattcgttctcctgcaactttaacgtcctgatcggcgggatgccgcgcgtgtgcggcgtgcgcacgctgattgaggagtgggcggcgtttcgaagcgaatgcgtgcggcggcgcgtgttccgccagttgaacaaaaaaaaggaaaagctgcatctgctggaaggcctgtccaggattttgcttgatattgacaaggccgtgcggattgtgcgggagacgcaggaggaacgcgaggtcgtgccgaacctgatgatcggcttcggtatcgacgagatgcaggccgagtacgttgcggagatccgtctgcgccagctcaaccgggagcatatactcaagcgcacggaggaaatcggacagcttcgcgaggacattgcggagatggagtccattctggagcaccgcgaaaaaatccgcgcgatcatcatttccgaactggaggctgtcggcaagaagtacgccaaaccgcgccggagcctgctttattatccaacacagggcgaggatgaagcgggagaggagccggcgcccgattatgccgtccatctgttctttacgcgcgagggttattttaaaaagatcacgccgcagtcgctgcgtatgagcggcgagcataagctcaaagagggcgacacggttacgcaggcggtagaggcgaccaacaacagcgaccttttgttcttcaccgaccgcgggcaggtctacaaggccaaggcgagcgattttgacgatacaaaggcaagtgtgatgggcgattatatcccggcgcgccttggtatggacgaaggtgaaagcgccgtttatatggcggtgacggcggattacaccgggtatatgctgtttgtttttcaaaatggcaaggccgccaaggtcgatctggctggatacgcgacaaaaacgaaccgcaaaaagcttgtcggcgcctacagcacagcgtcgccgctggccggcattttccagttggcgcaggacgcggagtaccttttgacctcgtcggccgggcgcatgctgatcgtgcacacgggcgcggtcgccgtcaagacaacgcggtcgacacagggcgtcgccgtgatgacgcttaagaaaaataatttcgtcgagcgggtgcgcccgtttgaggaggggatggtagcaaatccccatcggttccgtacaaagacgctgccggcagccggcgcgctgccccgcgcggaggacgccggggagcagctcacgctcggataaaaaacaaaagccggacggtataggccgtccggctcgggttttatccccgtgcaaacgcaaggttcgaggtaaaaaccaagcttagtatgcgcgccccaggaacaaaacatgcacgcggcaaaaattttccaaacgggttgcaattgccgctgtaatctgttataattttatttgttatctatttgggcacgatggaatcggaggttaaaaatatgggtgtgatcgaagtgatcggcggcgtcatccttctggtggccgctgtgattgtaattgtgtcagctatgcttcaggagggcaagcagggcgcattgaacgcgctggctggctccaatgagtcgtcttatctcggcaagaacaaaaacaggagctttcaggcgactttggtgcgcgtcacaaaatattttggcatcgtttttatggtcgtgacgctggctgtctattttatcagcgccgcgctcaagtaacagagatgaaaaaaggcttccgccacagcggaagcctttttttatcagtttgtctgttatagccataggccggggcggattacaggcggcaaagggccgcgctccgcggagaaaatggccttgcttacaaggcgctgcgtgctgccgatgtgccggcgcctgtttttgcagcggctcaaaagccataaaagggaacggtcaaacgaatgctcgtttgaccgttccctttccttctgcaagctttgttttgggggggcggaacaaggcgcgcagataacgcgccgctgcctgcgcaaggctgtcttgatcgggagcgagctgccgccagatattgtccttcccgaatgggggaaagctctcaaagaccgcgaatccgtcgaatccaatttgccgcagcgcggcggcgacggcgggaaaatcgatgtggcctgttccgggcgcgcctttatcattttcacagagatgaatctccccgagatagcgggttcccattcgcccgattgcttcggtgaggctgcgctcctcgatattggcgtggtaggtatcgtaaagcagcttgacattgggcaggccgatttcatcgaccattaaaatcccctgcctcactgtgttaatcagatcggtcttgtaacggttgagcggttcgatgcagagtgtaaccccgtaatccgaggcgattctggctgcttcgcgcagagtgtctgcggcgctcctccattcggtctggcgctccgcctgtgtgcgcgggcggacgggcaggccgctgagatagagcggaccggcaaaattgcttgcgccgatcgccgcggcggtttcaaaacaacggcgaaaaaaacgaagcgcggcatggcgcgaagctgggtcagggctgcctggggcgcgttccggcgggattgcgcagcttacggacgcggacagtccaagcctgccgagccggtccgcaagcgcacggggacagagcggccgctcaccgacaaccacctccacagcgtcgtatccgaaggcggagatcctgtcgagcagggaaagatctgcgtccccaaggcagtcaagccagagcattgtatgcgcgccaagcttcataaaaggacctcctttgtgacggttcaggcgggcttgctgcccgcgccagtgccgaaataggcattgatgacccggtcgtcgtggatcagctccttggccggaccggaaagctcaatcctgccctggctgatgacataggcgtaatctgaaacctcaagcgcgatacgggcgttttgttcgaccatcagaatcggcatgccctggttattgatttccacaatcttttcaaacagctcctcgattacgagcggcgcaagccccatcgaaggctcgtcgagcagcagaattttgggccggcccatcagcgcccgtccgatggcaagcatctgctgctcgccgcccgaaaggctccacgaaagctggttgcgccgttcccccagccggggaaacatattgaacacatattcaagctcctgatcgtccctttttttcccaaaaaagccgcgccagtttatacaaccgacctcaaggttttcctgtaccgtaagcccgggaaaaacatgccgtccctctgggacatgcagcacgccgcgccgggcaatctgcaccgagctgtagtttcggatattttcactgtcccattcaatacgtccggtgtgctgcaccataccggagatcgattttaacagggtggtttttcccgctccattggaaccgatcagacaaacgatgcttttatcggatacttccaggtcgattccgcgcagggcctcgatcgagccatagtacgcgtgcaggtccttaactttcaacattacgctccctccccagataggcggtgataacgtcctcattggaggatacctgcgcaggtgtgccgcaggcgatcacctctccgaaattcagcaccgtgatttgctggcagacattcataatcatatccatggaatgttcgatcaggataatgccgatgcccatctcctgcgcagccatctccagaagcttgaccgcgttttcaatctccctgttgttcaaccccgccgccggctcgtccacgagaatcaccttggggtgtgtcaggatcgcccggatgatttccaacagttttttctgtccaaaggtcaggctgtccatctcgtcctccagacaaaaggagaatcccgcaagctgtgtcagatgctcgaggtcgttaagaaaatccaggctctttcttgaaataaaagatttccagaaggggacccgtttccccaaatcggccgcgaccaaaagattctcctcaatgttggagcgttcgaggaaacgcggggtctggaaggtgcgccccaatccgagatgcgcgcgctcatgggacggcatatgcgtgatatcgcgccccatgaaggtgatggagccgctgtccacttcataaatgccggaaatcaggttgagaagggtggttttgcccgcaccgttcggaccaatcaagccgtggatcgcacccggttccagctccatacagacatccagggcggtaaccacgccgccgaaccgtttatttaccttgttaagctttagaatcttttccatccgtcacacctccgcctggccgccggcgccgatccgcgttttataccccagatgcaggcgttcacggacctgcccggcaattttacgatacaacccggccagccccatcggcataaagaccatcagcagcataacgccaaggccgtaaaacaggcggatatactcctgaagcggtttgagccactcagggagcatcgtgataagcagcgtgccgacaaaaacgccgggcgtgctggtcacgccgccaagcatcgccataataacgaatgtggtcgactgatcgaaggtgaaggaggatgcgccgacaaaatggttggtatgggtcatcaaagcgccccccagtcctgcgaaaattgcagcgattacaaaggcggtgactttggtcttgtaaacgttgacgcccatcacctgcgcggcgatctcattgtcgcgcaccgaactgagcgcacgtccgagattggttttgcgcagcctgacgaccaccaatgcgcagaggatcgcggctgtcagcagcaccagatagttctgatcggatgttttggcctgcaagccgccgattgagaagttcggcacaccggcaattccatccggcccgccggtgacagcccgccagttgttgaacacgctgtatgtaatctggaccagcgcgacggtggagaaggtgaagaaggtacccttcagacgcagaaggaccatgccgatcaacagggcgaacagagcggaaatcaccattgcgcccgccaccgaaagcaggattggcagccccgccctcatagagaaaatagcggtcgcgtatgcgcctacgcccataaacgagatagccgcaaaagaaaccatcccgcccatcccgaggatcacctgaatcccgagacagactacaaaatagatcagcgcgctgttcataacggtcatcatgtatttgcccaagtggttcggcagcaccagataagcggcgagagcgagggtcaccagcagcgtcccccgcagaatacggatttttttcatatgctacccctcacgctttctctttgataagctggccgaaaaagccctccggccgtacaatcagcaccacgatcaaaaccataaacacgaccgcgtccttgtaggtggtggtgaaaagggtggcgaatgattcgatgattccgatcagcaggctgcccaacaccgcccctttgacatttccgattccgccgatgaccataccggcaaagcctttgagcataaacgaacccagtgatgtcgaaaccaaaaagagcggggcgaccagataacccccgataccgaccagcgacatgctgatgatgtaggtggcgatggtggtgagaatcgtcgggatgcccaacagctcggcggcatatttgtcctgcgccgcggcctgcatcacacggccggcatacagcttgtcaaacaggcagaaaacaccgaggatcagggccgaggcgatcacaatgatgaacaggtattgatactccagccgcgctgtgccgatgaccagcacgcccttgacaatcggctctgacacaagcggcacggtgccccagatcaattttaccaattccttgatgacaacggaggcgcccagtgtgctgatgagcacggtggcggaccaggtggagcggcgcagcggccagtagaccgaaaacatgaacagcgtcccgaacaatgcgaaaatgaccagcgcgacaagcgccatggcgtaaagaggcagatgggcctgataggtcaaagcataggtcacataagcgccgagcataaagaggtcgccctgcgcaaaattcaacacgcccaccgcgcgcaccagaagcacaatgcccatcgagatcatcgcatagatcatgcccatcgaaaggccgattacaagaagctgcaaaaagattccaaagttcacagagttccctcccaaatcagtcctttgcgcggatcaccgggagcgccgccccgcggcgctcccggtgatgctgcggcttaaagccctggttttgcaaccatatcgatcataacgccctttttatcctgcgtttgggtaagcatgatcgaagttccgagcgaatgatcgccctccagataagtgtaggaggtcatcgctcccaccacgtccttggtctgcttgagcgcctcatttacagccttgggatcgtccgtaccggcgcgggtgatcgcgtcctcgagcagcagcatcgcgtcgtaggcgcagacggactgcatgtccgaatcgcggttgtaagccttgcggtatgcttcgacaaacgccttgcccgattcggtctgcacttcgttggaccagtcggccagcgagtaccagccgttggacgcctcgccggccgtatccatcgcgagcgcggacgcatactgtgagcagcccatcagcgggagctgaatgtccatcgcttcgatctgcatcatcaccaaagcggcctgatcctgatggttgatggcgatgatcccgtcagcgccgctgttgacgatctgtgtgagaatcggggtgaactgcttttcctcggccgtgcattccacctgaatggcaagctccatgccgttctcctcgatcgccttcacaacaaagtcggccatgccgcggccatagctgtcgttgacgttgaggatcgcgggttttttcatgccgagctggtcgcggcaggccagcaccattgcggggctgacatttgcgtccgacaggcgcagcatccaataatagtcgttgttcgcgtcaaggcaggcctggctgctgttgccggcaagcagcggaatttcgtagtttgcgacttccggcagcaccagcgtgatctggttgctgtatccgttggaatagaccgcgcaaaggtcatcgtcgctcaaagccttgaccatcgcgttcatataggtctgttctgtctcgccgttgtcctcatacaccagctcgactggacggccgaggataccgccccgggcgtttacatcctccttccaaagctcggccccctccttgcagtattcgccgtggcccgcgttcgcgcccgaaagggtggtcacaatcccgatgcggatagggtcgccggccggcgccgtatccccggcgccggccggcgcgctggaaacagcgggagcgggagcatccggcgcatccgaggcagccggggcggggtctgaggagcctgcgccgcagccgctgaaagtaagcgccgccgcaagcaggaacgcggagatggataaggcttttcgatggttggacataatacccctcctgacgaattggctaaaaatttattatttacttgcttttattatagatatcttgctgcaatgtgtaaatggacaggattgccaagattatcattgtaaaaatgctagccggcgccatgaaacagatgctcggaggacatgattatccaattttgtatggagaaaatgcccgaaagggacgcttttttaaaacgatcttgtgctttgctaaaaataagttaaataatgatgcaattatgcgttgatttttgtcgacattatgtaatataataaatgaaacgaataagggaggggctgctgatgccgggcggagctgggaggagagggtttttgagggatatgccggttcgatggctgatcctgtctctgacagggctggccgtggcgctgcctgtgctatgcggtggattgctgctggaatccacctcccgcgacctggtgctggatacatacgccgcgagcctcgcggacagcgtggccgccgcaaaggatattgacggccatacgcccgggcagatcgggcaggaggtggagcggcgcctctcatggctgacaaaccattatcaattcaccctttacatcacccagggcttggaggcgctgtacagccgggactaccagcttgcgccgcaaacaaattcgtttcccctttcatgggaggcgctcgggcaggtgcagcgggaagcgagccggaccctgctgtttcaggacctctatcgcggacaactgctctatgtgtgcacgaagcttcaaaacgggatgacgcttgtgtgcatctttccaaccgcgcagtttcgggtaacagtcgaacggttctggatggtgatcctgctggcgatgctgtttgcgggggcgatgctgttcggggcgaatctgcttttaaagcggcttgtgaccgacccgctggagcagcttgtgtatgaaatccgcaatcctgatctgccaacccgtaccgaaggatatttggactggaaaaatgagatcgggcggctgtgcgatgcgtaccgcagccgcgcgcaggagttttcggacagcctggccaagatcaaccagctcaatgatcaaaagcgggaatctgaactggatgtgctgcaaaaccagattaattcgcatttcatttataataccctcaacaatatccagtggctcgcttcggacggacgcacagaggatgtaatcgcaacggtgcgcgcgctcgattgcctgctcagggcctgctcccacaatgaggacgagcttgttacgatcgaggaggagctgggatatgtagacgcttatcttaccgcacagaagatccggtttggggatgtgtttgactacagttttgagatcgatgtgctgctgatccagatgaaaatccccaagtttattcttcagccgatcgtagaaaacagcatctaccatggcttcatcaattgcaaccgccagaacgggcagattaagatcagcgtttcacggcggggacaccggatcgatatccgggttgcggacaacggcatcgggatcgaaaaggagcgcatccgcgcggtgttgagcaaccggtataaaagctccggccggtatatgggggtcgccctgggcaatgtaaacagacggatcaagctgctctgtgggagggaatacggcttggggatccgcagcgaatacggacgttacacgctggtggaagttaccatcccaatcaccctgtaaacagacaaatgcggacaaatggaaaggaaggggtgcaaaatgccttataaggtgatgctggtggacgacgacagccttgtgcgccgcggcctgaaatcctttgtggattgggagaaaaaagggcttgtgctggcgggggaggcggcggacggaggcaaggcgctcgagctgcttgagagcctgcgccccgatattgtgatcacggatatgtatatgcccaactacaatgggctgaaatttatccaggaggcgcaggccagctttcccgacctgctgttcattgtcctgagctgccataacgatatccattatgttaaagaatcgatgcggctgggcgcgtttgattacctgctcaaaagctctattgtggattcggatgagctggacgttgtgctggataaggcggttgcgagcctggatgcacgttcgcagcgcaatggggcggagttgtgggaggcggaaaaggctccgcccgaacgggtgctgttgagcttcctgcgcggcaaaacggacaatgtgtctgcggtgcgcggctatcttcaggcccatcagatcgatcccgacagccgccagctctttctgcttgccatccagatggacaattacacaggatgcgtcgcatgctttagggctggggacctgtttgattatgcggtggagaatatccttcaagagatcgtgggggaatatggcggcggtatcgtgtttcattcggaggggcatgtgttctataccgtgctgcatgttgcggcaaaaagcagcatcatttccccaaaggaccgggcgttgagcatctgcgagcggttccgcatcagcatcaaaaacaacctcaaaaatacatgcagcatctatattgaccagccacgctggctggaggagctgcccgcttcttacatcgagatcaccgaggaacaggaggccaatcaccacctctattatgatacgatcgtaaacctggaggacaacagcctgccgagcatctaccaacgtgcggcggatgacggcgcgctgccggtcgatccgatcgacgacgtgctcgattacatccatcagcactaccgtgagcagatcagcctggatgatctggcgcgaatttccaacttcagcaagtatcatctgtgcaaaaaatttaaggaaaagacaaagaccagcattattaattatattttgatggtccgtatcgataaggcaaaggagctgctgctgcaaaatcaggaccggatttttgtgatcgcgcaaaaggtaggattcaacgatacgtcctactttaaccgcatttttaaaaaggtgacgggttacacgcctaaggagtttatcgaatataaccactctgtgctgtagcggggacgtgagaaacaaatagtatacaaaaataaatacaattttgcattataaatcttgtacaaatctctagttgcattttggagacggagatgcgataatatttttgaaaaatgcagacgaggcatttgagaaggaatggagaatgggacagcatgatcgagcaggagcaccagcccgttactttgagcgtttataatgaactgaaaaataaaattgtgagcctggagctgatgcccggccagatcctgatggttcagcagctttccaaggacttcgggatcagccgcacccctgtgcgtgaggcggttgtgcgtctgcgggacgatggcctggtggaggaaagcgacggccgcaagttccgtgtttctgaaattacatggcggatgattgacgatatctatgaaacgcgccaagcgcttgaggggctggtggtttcccggctggccgaatcgcttgtccccgagcagatcgaacggctggacagcctgctcgggcagatgcgccaggccgtggggcagggcgaccttgcgcgctatttcgaactggatgacgagtttcatggcgccttgcttcggatacatggtaaccgggtgatcctctcctgcatcgggcggatcaaggatcagcagcagcgcatccgctttttgacggagggtgcgcgggatcggaccgaggagagccttgcggaacacgagcggattcttcaatgtctgcacgcgcatgatggcgccggagccagcgagcagatgcggctgcatttgcagcttgcgcgcgaggatacaaagaatcttttgatgacgcggtacccgcgtccgatggtcaaggactgaattccgttccgcccctgggaaaggcgggacgcttttcttatgaaaaaatgcatacatttttgtatttaaaaatggagggatggatttgcagcacaggatatttgactatgagtcgtcagagcagcttttgcacgaccgccagatcgcgggcttacagctcccctttgcgcgggaaacaggcattctcaaaacgccgctccggttgggccaaaggcagatcgaaaaccgtttggccgcacagcctgtagagggttttgacgccctgccggacggttcgccgagtgaaaaaaacatggcaaggtatcgggcctacgccgccgggatgtcaggaatgatctggctggagtctgtttccgtatgcgcgtccgggcgctctaatccgtcgcagctctggctgcgcagggaaaacgtggaccggtttcgctgccttgctgacgagattcgtacggcggccaattcttggggacggccctatacggtcgtccagctcactcattcgggaaggtacagcggccagcacagtgccgccggaccggaaagcgcgtttcacaatcctctcatcccaaaggaacatgagcggattttgactgacggggagctttcaagcctggaggacgattatctgctcgcggcacagcttgcgcaggaggcggggtttgacgcggtagacgtgcgcgcctgccacggctatctcatcaatgagctgctggcggcgcgggaacgggaaggcagatatggcggcggctttgaaaaccgggcgcgctttctgctggatgtggttgaaaagatccgtgcgcataccgaaattgaggttgcggtccggctcaacgtatacgacgcgcttgcttatccctatggatttggcgtttcccaaaagggagccgcgattccggaccttgaggagccggtccggttggccaagctgctttttgagcgtggggtgaggcttttcaacatcacctgtggaattggggcctgttcgccgcaggtgatccgcccgtccgatacggggggagaaatctatcggaccgagcatccgcttacaggagtcgaccggatgctgcggctgacccggcagatcaaacaggctgttccgcaagcggctgttgtggcttcggcgtttacatggctgcgggagtttggcgcgaatgtggccgcgggcggcatcgaacaggggtggttcgattttgcggggttcgggcgccagccggtctgttatcctgactatgcgcgggatattctgacaggcggcggaatgaaacgggaacgctgctgtacgacctgcaacggatgtatggcatggattaaaaaaaccgggaaggccatccgctgtgtgaaggcggaaacaggcggccggacaaaagaaagggatgcaaaatgaagcaatatcgctgcgggctgattgcccgggacatccacaattcgattaccccgtcggtctatgaggtatacgcccgggacattggaatggagattgatttttcgcttttcaacattgaaccggagcagttgaaggggcaggtggatttttgccgggcgcatctggacggatttaatgtcacgatgccctataagcagaagctgctcgaattcgtcgacgaagcggatgattcggcgctgaaatgcggatcgaccaataccgtccttgttcgggaaggcaggctgatcgcctataataccgacggatgggggctgatgaaggcgctggagctgttcggcgtcgccatagagggcaagcgtgtggtgatgcttggcgctggaggggtcgcgctttcgatcgcgtatcagctcggcctgcacggggtaaagcaggtcagtgtggtcaacctctttttggaccaggcccaaagcctgtgcgaacggtttggacagcgtttcgctcctgtgccatacaccgcggaggatttatgccgctgctgtagggacgcggatctgtttatcaatgcttccgtggtggggcaggtcggatacgacgactttgtttctctggaatttttaaaagaactcaggccgggcgcggcggtctacgatgtgaattactccaatccggacgcccggctggtgcctgcggcgcgtgcgctcggtttgcctgcatggatcggcaagccgatgaatgcctgccagggggtacgtgcgtttgaaatctggtttggaaggacaccgtccgaccactgtgtacgggagctgatcgaccgccttcaaagcggcacaactgtttagggcttatttgaaaatagagaaaggaaggcttgctatgaaaaaggttgtttttgtatccaccgttgcgggaattatccccggtatgaaggaagcttttgcccggcaatttcctgacgtgcagctcatcaatctgctggacgacggaatcatcccggaaatcacggaaaacggcggaaagctcaccccggatattataaagcgggtcgcggattacggcgtgactgctgaacggtacggcgcgtccgctgcggtctgcatgtgtaccaccattgcgccggcggtggatgcggcgcagcccgcggtgggtattccatacctgaaaattgatgggccgatgcttgaaagggccgccacgatgggggatcggatcgcgctgctggtgacggctgaactgaccttcgggccttccgcgcagtctgcccggaaggcggcggaaaagatgggacgcgggcaggttcaaatcgacaccatccttgtcgagggcgcatgggcggcgctcaatctggagggggacaaggcggcgcacgaccggctgatcgtggagaaggcaagagaggttgcgggcagctacgatgtgatcgtgctcgaacaggccagcatggtggacgtggcttccgcgctggaggatctgggggttccggtgctgacgagcgtggaaatggggatcgcacagctcgcgcaatatctgtaaacgggaaatactgaaaggatttggatgtgatgagatgaaggtgacggacgtttccgcaatgatcctgcgataccaatatgacaatgcgatcgcggacgctcaaaactatttttatacccgcagcgcggtgatcgtcaaggtgaaaacagacgaagggatcgaaggaattggggagtcggcctgcttcggcgggcctgccgagacaacgaaatatgtgattgagcatgagctggccgatcttgtcaggggggaggacccgaccaatatcgaacggatttggcgcaaggtcaacgaccgcacccgccagcacgggcggggcgggatcatcaccgccgccctcagcggcattgatgtggcgctgtgggatattttaggcaaaaaagccggcctgccggtttacaagctgttgggcgggtacagcgaccggctgctgccgtacgccagttcgggcttttacagcgtgggcaaggatgcgcagaaactggcggcggaggctgaaggctatttccggcagggatttcgctatgcaaaaatcaagatcgggcgcaatccggacgtatttatgtcgccgattgaaaatatgctcagcccggaaaaatgcatttataccctggaggaggagctggaacgggtacgggcctgctgcgaggcggcaaagaaatatggcgcgcggatcatggtcgatgtaaacaacgtctggaacacatacaccgcaatccgcatgggtaaaaagttccaggagatgggggttttctggatggaggaacctctcagcctggacaatgtggacggctcggcggagctggcccgtgcgttggatatgccggttgcgggttatgaatctgaagtggggctgttccgcttcaagcagtttatggacaagcgcgcgatcgatattgtacagcccgacgtgatctggagcggcggctttaccgagtgccgcagaatcgcccattatgcgcaggccaacagcctgccctgtatgccgcatgttttttcttcggccgtgagcctcgcggcaaacgcccatttcctggcttccctgagcaaccgggggattttggagatggaccgcaatccttacccgctgcgcgacgagctattgaccgagccgattgaaatggcagccgacggctatgtctatttgccgcagaagcctggcctggggatcgaactgcgtgaggacacgattgaaaaataccgcgtggactgaaaacggcggccgccggtgtctctgcgcgccggggccgtgtggggaaatcgccgaatccgttggaatttcacttaaacaggcaaaaaataaagcccgatgggggtccatcgggctttcggttgctagaaaataatggaaaacgcatcgatgcgctgttgctgtaaaaatccatttttgtccggacatgtgccggacaaaaatacattgaagcgcaaaaccgctctgcgaacggttttgtaagaggaagggtgggactggcgggaaaacagatgaacaaggcgaacctgtgagccgcagtaatttctggttgcccgccagcagcgtgtcgagtttctcgacatgctgaaagcccgatgggggtccatcgggctttctttcatggatacgctgggcgttttggcggatagggcttacgggcggttaaagggcgtgacggttttgacaagcgtttcatgctcgcagaattcctcgaagaaacgttcgcccgtaccagtgaaaccgcatttttcatagaagggtattgcgtaaagctgcgcgccaagcacgattttttcggcgccctgttcgcgggcgaggacttcgaggcgctccatcagcagacggccgagccggcggccgcggtgctgcttgagcacggcgatgcgtccgatgtggaacgcgccgctttcatcgcggtaaacgcgtccggtcgcggccggcttgccgtcgatatagacgaccatatgatcggaaatagcgtcgaatgtgtccacatccgggatcgtgaagccctgctcctttgtgaacacctcgtcgcggacgaaaaaggcgtcggtaagatcgtctctgccgttaaaaaagcggatttccataaacgtcctccaaaagcgccgccagccaaccgcgctgggtatggccgcatcattgacagcggccatgctttgcacgtgcggtctgcttcggtccggtgggcgcgttgattttaccgtcccattatacgccgtcatgcgcggaaaatcaaccgcagcgccagcatcaggatcacgccgggaattccaagaacggttgcgatcgaaacagatattggtccaggagcgattgtgacgccggtgaaggcgccgaggtaggcgacgccgaacagcgccaggttgccggtgacggcggagaaaagcagcgcgcgcaggaatttgccggaacgccagagcgcagccaggacggcgatacacgcggcgccggccgcggcaagcagcagggattgggacatcattgacacctccgctccgggcggctcttgagccgcctgcatgttagccgcctaaaagccgtcgatccggttttggggcgggcttctgacaaaagcatatgcgcgcggacatgcaaaaagaccgcccaacacagggcggtctggatttgcaggcgcatagagagggagcctgtaagccgggttctgtcgtggacgacgatctttcttggccgcgcgtcgccgcgcggctccagccgcctttcgggacccggcgggcagccgcattgtcccagtcggcgttgcttcggatagggtttacatggcaatgcggttgcccgcatcccggtgagctcttacctcgcctttccatccttaccgcaaaacgcggcggtatctttctgttgcactttccctcgggtcgccccggcctgccgttagcaggtatcccgccctgtgaagcccggactttcctcacgcccatggggcgcgccgccgtccggcccgctctctatacatgttttattgtactataaattgggcctggacgtcaacagaagattttgttcctgcaaaacagccttgtaatctatgtgaattcggggaaaaaatctaaaaaactgcaatatttgtattgcatcgctgcaatttgttccgtataataaataagaaacagaaaaacaaggacgctggattttgtttgtgcggcgcgttaaactgatagcttgtaaaattgctgtgcggtattttccaagccgcagcctggtttgttcaagacgccgaaattgtggtaaaatttttgacaatacagtatatccgtgctatgattgaaaaaaattttataatacaatggacgcaatcaataaaggagtgttcgatatgatggagatcaaggtcacgctgaccgatcatcccaaggccaagcccgatgagaacaacctcggctttggccatatctttactgaccacatgttcctgatggactatactgcgggccaaggctggcatgatccgcgcattgtgccgtatgggccgatcccgatggacccggcgtcgtcgtgttttcactatgcgcaggaaatatttgagggcatgaaggcgtatcgtaccgccgaaggaaaaattcagtttttccgccccggtcagaactttaaacgcctgaacacctcctgcgaacgcctggttgtgcccaagctcgacgaggagcttctgatggaaggactcaggcagcttgtcaccatcgacaaggattgggttccttccgcgccggggacatcgctgtatatccgcccgtttgtgatcgccaaccaggaggttctgggcgtgcatccgtcgacgcattatatctattgtgtcattctttcgccgtcgggcgcctattacgcgggcggcatcgacccggtgcgcatttatgtcgagacaaaatatgtccgcgcatcgcgcggcggcatgggcgcttacaagacgggcggaaattatgccgcttccctgatcgcgcaggaggaggccgagaagcagggctattcgcaggtgctctggctggacggcgttgagcgcaagtatgtcgaggaagtcggttcgatgaacgtgttctttaagatcgacggcgaaatcgttacgccggagcttgacgggtcgatcctgccgggcatcacgcgcaaatcggtgatccagcttttagagtcgtgggggatgaaggtgtccgagcgtaagctctccatccatgagcttgagcaggcggccagggccggcaagctggacgaggcatggggcaccggcaccgccgccgttatttccccgatcggcgagctgaaatgcggcgatgtcaccacggtcatcaatgaaaataagatcggtcccatcagccagaagctgtatgataccctgactgatatccagtggggccgtatccccgatccgttcggctggatcacgccctgctgctgaacagtttttaggagtcagtaagcccgcccgcccgttttacaggcgggcgggttttggatttgatgcgaggtgacggcatggaggaatatacaacaatccgggcggcggcgtccgacgaatttgtcgagcggcgctcccggtttatcggatacatcgcgcctgtgcgtaccgaggaggaagcggccgcttttatctccgaaaaaaaggcgcttcattgggacgcgtcgcacaatgtctacgcatacatcctgcgcgagggacagacgcgccgctattcggacgacggcgagccgcagggaacagcgggcgtgccggtgctcgaggtgctccagcgggagggattagtcgatgttgccgccgttgtcacgcgttatttcggcggcgttctgctcggcgcgggcggccttgtgcgcgcatattcacacgctgccaagctggcggtcgatgcagccgagcgcatggtcatgagtgaatgcgccgaactgtcggcgatgttttcctatgaccagtacggacggatcgagcggctgcttgcaaaatacggcgcgcgcacgcttggttccgattacgcggcagatgtaacgctgcgcctgctgatgaaggcgaaccgggtcgaagcgtttcaaagggatctggcggagctgacggcgggccgggtgacggcatgtgtggaggaccgccgttatgactgtatgccttagaacctgtattcacagccgcaaaacgttgcccaggcgggccttttgccccccgctccacgttaaattttcttgccgggcgacagcccgcccgcaaaaatttgccttgattgggtacaaaatcccgtgcctgcccagcgtcctttggctgtgaatacagattcttaaaaacagtcgtattttgtaagttcctgccttttgcaagaaatttttgctccaggcaggaatttttttatttgcggagtataatatattagaacatacaatcaaaatggcaaaaaacgcggggaaggaggcgcgctatgaccatccgcgaacagacgcaggccttgcaggcgcagagcctgtcggagcacgcctgcctgccgcagcattcgcgcggacgcgcccgcccggaggaggaatgcccgatccgcacgccgtttgcacgcgaccgcgaccgggtcatccatagcaaggcgtttcgcaggctgatgcataaaacacaggtgtttctgtcgccggagggcgaccattaccgcacgcgcctgacgcacacgcttgaggtcaaccagattgcaaagacgcttgcagtcgcgctgcggctgaatgaggaactgaccgaggcaattgcgcttggccacgatctggggcatacgccctttgggcacgcgggcgaacgggcgctgcgggaggtctgtccgcatggcttttcgcacgcgcagcagagcgtgcgcgtagcagaccgcctggagaaaggcggtgcggggctaaatctgacctgggaggtgcgcaacggcattgcgtgccattcttattccaatccttcgccggaggggcgcgcggccacgcttgaagggcgcgccgtctattttgcggacaagatcgcctatctcaaccatgaccttgaggatgcgctgcgcgcacgggtgctgtgcgacgacgatattccatggacgatcaaatacacgctcggccgcacgaaatctcagcgcatcacgacgctgatcacctcgctgatcagccacagcacagacgatatccgtatggatgagcagattggcgaagcgtttgcccagttcaattcgtttatgtatgaagcggtgtacctgaacccgacagccaagggtgaggagggcaaggcggaaaatgttgtcaaaagcctgtacgggtattttacagagcacccgcaggcgctgccgggcgaatatcaggctatcctggagggcgagggcgcgccgcgtgccgcctgcgactacatatcgggtatgtcggaccgtttcgcggtcgccacatatgaaaagctgtttgtaccgaagccgtggtccatttgagaacgacgcgccattttagaagggaggaccgtttgtttgatacctgatctgtttttacaggagttgaaaaacaacagcgacatcgagcaggtggtgtcatcctatgtccgtttaaagcggcgtggccgtatcgccaacgggctgtgcccgttccattcggaaaaatcgccgtcgtttaccgtttatccggacaaccagtcgttttactgctttggctgcggcgcgggcggcgatgtgatcacatttatccgcaagattgaaaaccttgaatatgtcgaggcggtccgttttctggcgcagcgcgccggcatggcgatgccggaggaggtcgcggacgacggcgcggcgaaaatgaagatgcgggtttatgcgctcaaccgggcgctggcgcggcattttcatgattgcctgaaaagctctgcaggaaagccggggcttgactacctgcatggacgcgggctgacaaaccgcacaatcacgcatttcgggctgggatatgcgcctgaggcgtgggacggcgccgttaaatttctgcgcgcgcaggggtaccgggatgacgaactgctggcggcggccgtggcggcgcgcggcagaagcggcggactgtacgaccagttccggggaagggtgatctttccgatcatcgatctgcgcggcaatgtggtcgggttcggcggacgcattatgggcgacgcgcgcggcccaaagtatctcaattcctccgatacgcccgtgttcaaaaaaagccgcaatctgtttgcgctcaatttcgcaaaggcatccaagcgcggcgggctgatcctctgtgagggatatatggatgtgatcgcgatgcaccaggcggggtttgacaacgctgtcgccacgcttggaacggcgctgacgccggagcagtcgcggctgatcgcacagtatgcgcaggaggttgttttatcatacgattccgacgggccgggtcaggcggcgacaaaacgcgctgtttcgctgcttggggagacgggggtgaaaatccgcatcctctcgatgaccggcgcaaaggatccggacgaatatatcaaaaaattcggcgccgagcgtttttctctgctgctttcgggtgcgtcgaatgcgacggagtatgagatcgagaagctgcggcgaaaatacgattgcgacaccgccgagggcaaggttgcatttttacgtgaattcgccgcgctgatggtgtcggtgccgaacgccgttgaacgcgacgtatacgtttcaaagacggcggcggagcttgaagtatccaaaagtgcgattgaaacgcagctaaaatacgagcagaagcgcgccgccaaacgccgcaggggcggcgcctcccagctgcgtgtctacagcgaggccggacccgccgagcagcggcgcgatcctcagcgagcgcgttatatccggtatgcgcttgccgaggataagattctggcgattctgatgaagaatcccgattattatgagcacgcggcgcagcgtatcgggcttgacggctttgtaacggaccgcaaccgcgcgcttgcaaaagtgctgtttgagcgcctggccgcggggcagtcggtggagctgccgctgctttccgcacagcttgacgaggagcagatggcggcggcagcagggctgctcaattccatctccggcctgacctttggcccggaggatcttgacagctatatcgatacattactcagctttaaaacagtcaaatcgcaggatgaagtggctgccatgacggacgatgatctaaaggcgtacatagccgctttggcgtccaaaaagaaataaacaaagacccagctgcgtcctgtggatgcgggccggggtcagggaaaaacaggcaacaggattgataatagggggaccgcatcaatgggtgtacaggaaaaaaaggcgatcttgaaggagcttttggagagcggcaaggccaagggaaaattgacaacaaaggagatcagcgacgctctggaggagcttgattacgacgttgaacaggtcgataaaatgtatgacctgcttgaacagaacaatattgagatcattgaggacatggtcacgcccgttgaggaggacttcaaggatctgggaaaaggcactgacctcgacgttgcgctcgcggctgagggtatcaatatcgacgacccggtcaaggtttatctcaaggagatcggccgcgtgccgcttctgtcggccgacgaggagatcgatctggctgtgcgcatggcacagggggacatcgatgcgcgcaagcgcctgtcagaagcgaacctgcggcttgtcgtcagcatcgccaagcggtatgtcgggcgcgggatgcagtttcttgacctaatccaggaaggcaacctcggactgatcaaggctgtcgagaaattcgaccatacgaaggggttcaaattttccacctatgcaacctggtggattcgccaggcgattacacgcgctatcgccgatcaggcgcgcaccatccgcatcccggtgcacatggttgagacgatcaacaaggttaaaaaggtttcgtcgcttctgctgcacaaaaacggtcatgaaccgaccgcggaggagatttcagcggaacttgacatgccggtggacaaggtgcgcgagatcatgcgcgtggcgcaggagcctgtctcgctcgagacgccgatcggcgaggaggaagacagccatctgggcgacttcatccccgatgaggacgcgcctgccccggatacggccgcgtcgcacacgctgctgcgcgagcagctttccgaggttctccagactttgacgccgcgtgaggaaaaagtgctccgcctgcgttttggccttgaggacggccgcagccgcacgcttgaggaggtcggcagggagtttaacgtcacgcgtgaacgaatccgccagatcgaagcaaaagcgctgcgcaagctgcgccatccctcgcgcagcaaaaagctgaaggattttctcgattgaccgaaaaaagccccgctgcggcggggtttttttgttggttatgcagttcgtttgacagcaccggaccttttataaaagcgcaaattccggactgtcaatgaccgccttcatcgagcaaagacagaatggatggccggcaggatcgagcatgacgcgccagctgtcggaaaactgcttctccgcaggctttgccccacaggagacggcatggcggactgcttgttcaaggtcattgacggcaaaatccatatgcgcctgttgttgctgtgtcccgggggtttggggccaaacgggcgcttcatgctgtgcattcttttggaacaggatgccagggtatgccccctgtgcctttcccggcgcgccgacacatgcgaattcttcatcatgaaacgcgatttcccaaccgagaagcgccgcataaaattttgccaattcatacgggttcttgcaatccaacgtaaacgcatataatttgatttgcagatcatctgacatattaaaacctcccataccgtattgctgctggattaggggttgcagaaaaagacggcagctgcgatttttcaaacagctcccagacggccgggatgtatccagcgtgatttaatcatatcatatcggtttgttaagttcaaggattgtaaaaaggatgccggacggatggcttgacaaaatgaccgccctgtattatacttataaagtatactttctgctgcggcgggtggctgcggcggataaaaggggcgaaaacatgtatattacgcttgaggcggattatgccgtgcgcatcgtggactgcctggcgcagcatcagatgcgcatggacgcaaaaagcctttccgcggcaacaggggtgacgttacggttcgctttgaagattttgcgcaagcttgtcgcggaggggattgtgcgctcctataagggtacgcagggcggctatgagctggcgcgtccggctggagaaatcgctcttggcgaggtgatcgagattgtcgagggaccaatcgtgatcagccgctgtgtcggcgacgatacatttcagtgctcgcgcgtggaaaaatgcgcctgccgctttaacaagacgtatacggaaatcgcgcagctcgtgcgcgaacatctgtatgccgtcaattttgaacaatgagcgccgaactgctcgtcggcctgctgttgggaacggcgtgggcgctgatcgacgtatggcttttgcggcgtgcgattaaaaaggcgtatgcagttccaaagcaggcacagcgtataatagcggcgacgctcgccgcgcgctatctgttgaccttcgctgtattggttgcagcactgctgctgccgggcgtggatgcgctgggagccgtgattccattgattatacaaaagattgccgtcgcggttatggcgctgcggcacaaataagaagctgactcgaactctcagtttttgaggcgggttggaaacattgtactgcggaaaggagataagcaggatgacagaacgggaaaagatgttgtccggcgcgctttataatgcgggggacaaggaactggcggaggcgcatatgcgtgcgcgcaggctttgcaggcagtataatgaattgccgccggacgaggaggaagcacgcgaccgcgtgcgtatggagctgcttggcggatataagcagtatgcatatatggagccgccggtatggttcgattatggctgtaacctttttgtcggagagaatttttatgccaattataatctgacggtgctcgattgcgcgcgtgtgaccattggcgacaacgtgatgctcggcccaaatgtttctatttatacagcgacccatccgcttgatgcgcgggaacgcgcgtccggacttgaaatggcacgtcccattacaattggcaacgacgtctggatcggcgggaatacagtgatcaatccgggcgtgacaatcggcgatggaactgtaattggttcgggaagcgtcgtaacgcgcgatatccctgcgggcgtgattgcggcggggaatccctgccgcgtactgcgcccagtcacagaagccgaccgtatagggattatgttataaacaatcgctgtatctaagaagctgtaccaactgcctccggttcgtgtaagcaaaaaagaatccgccggtaccggcggattcttttttacttggtacgcaatgaatgatcgggtcgaacagcgtcggccatggaagaatgcaatattgattgttccgcacgagaacaaaacggcttcgctgtttcgtcccggtcaggccgtgtgcggatgtgagggcgtctacacaaaatatctgaatagatcacaagtatacatatatggaaaaaagccggctataacaaccggcttttttccagtaaaactggtgcggtggatgggacttgaacccacacgctcgcgcacacgcccctcaaacgtgcctgtctgcctattccagcaccaccgcattttaactttttaatcaattccaaaatgagagaaatccattgtctgcattttctctttgttaatcccgacgaagtttatcttaccataataaaagagacatgtcaagaaaaaaagcaaataatttggaaaatctgtgtaagggcatgatgacttcaagtataatcgatgtaaaacgtcccggcaagaggacaaatgaatgcatatttatcatgaaagcggcgaatatacagtgaagaaactgtggaatgaccagtggaatccttgggtgaaactggggaaagccgcatgaaatgggcgaacagcattgtggaaaacttggtggaaagtgtttataactgtttgtatatccaagtgcggacagtcgtgctcacgaaattcacacattgtttgctttacaaacaccgtggaatctgataaaatgcagaattacaggtaatgaatttgcgaccaataggagcatgacaggatgtataaagaaaagccggtaaaaatcaaccgaggggataatccccatcatcttttgacagtggtgatcctgctcgctttcgctgttgttatttcgctggtgattgcaattgtatggcagaaagtgtctgataggggcgcggatttgagccgttatcagacgctgtcctcagtcgtcagcgggacgcagacagaatccgatgcgctggaatcctcctctgctgcaaaatcgtcgtctgtgccggtgccatccgaaccagaggaacagaaattgcccgtgttcgacggcgcggtgcccgagtcagaacgtgtgatgggagattatttcgacgatgcggtatttgtcggcgattcaatcacagaagggatcatgctgtacggtatgatgtccaatacgactgtatttgctggcacaggcgtcaatctattgacggtttattctgcacagaccgtcaagcaggaagatgggtcgcgtatcccgatcatggacgcgcttgatgcagagcagtttgccaaggtttatgtcatgctcggcggcaacgaagcgcgcgaagatgtagatacatttatttcgcattacagcaaggtgatcgacgatctgaaaataaagcagccgcaggcgattatttatattcaatcgattctgcctgtaacaaaaaataacaactataacctggacaatactcatatcgatgccttcaatgaggcgctgcttacgctctgtaaggaaaaagaggtctactttgtaaatgtggccgaatgcatgaaggatgaaaacggaatgctgccagatgaagcttcgccggctgacggaatgcattttgggccggattattatacaaaatggtttgaatatttaaaaacgcatacagtagaacaagcctaaataataatgacaaagagggatgtatcagatgatgaaaagatggattgcagttgcgttggcggcggtctgcgccttctccatggcggcctgcggcggaaagtcgggcggtaaggagccggcggcggccgatgttgtacaggcagtcgcacagggtttgacattcaaggacacgatgatgacggtcgatcaggatgtattctataatttttatgacatagacgcgcaaaaggtcgcggacgtttctatgtatacgagcagttcacgtgcgacggccgaggaggtaacggtcatccgtatgaaggacgcggctgatatccagcttgcgcaggatgccattgcagcgcgcatcgaggatcaaaagcgttcttatgagagctacatgcctgacgaaatgcccaaaatcaacaatgctgctgtatatacacatggcagctatgcgattctggttgtggcggatgatacatcgggcgctgaaaaaacctttgaagcacagttttaataaagcatcttgaatgaacgggggcggcgcggatgcgccgcctctttttgggaaacaaggcaaaatcggaccgcatggcgtcgaatcagacagaataaggccgtttgtacaggttatgtaaattttttgtcgattcactgcgccatacgattgcaatcgtgattttttgtggtataatatgcgtagtgcaaacggcttttccgtttgcagccgccattctgcggctggcaagcccgaatgggcttgctgctgtggtataataaccgcagagcggttattataccaattttatggccagggcggtgcgcggcctgcttgcgccaaaatggccgatgataccacctatggctggcccattgtgtgtgaaattgttaatagggcgcgtttttccaattgaaattatgggaggtgacggcgtgaatcccgaccctggaagtacaggctatatatatatcatgaatttattcattactccgggggcgcgccgtatgttgtaaagcggcccctgacagaaaggggctttttttgcatgctcaatttttataagacggttgacaaccggattctgcgtttggatgcgccggagccgggctgctggatttccgcaatcagcccgacggaggcggaggtcgcttttttgacaaacgacctggcggtcgaaccggattttgtacgcgctgcgctcgacgaggaggaaagctcccgtattgagagcgaggaagggcagacgcttgttattgtggactatccgtcggctgaagaacaggcggacgaaaataagacgctgctttataccacgctgccgatggggattatcagcacacctgattatgttatcaccgtttgcattgaagaaaatttgacgatcagcgatatggccgaagggcgggttaaggggcttcaaacggcgctgaaaacgcgctttttgcttttgacgctgctgaggatcgcacagagatttcttgtttatcttaagcagatcgacaagatttcatcgagcactgaacagcggctgcatttgtccatgcggaacaaggagctgatccagctgctcggcctggaaaaatcgctcgtgtatttttccacatcgctcaagtccgatgaggtgacgctcgaaaaaattctgcgcgggcggatcatcaagctctatgaggaggacgaggacctgctggaagatgtgctgatcgaagtcaagcaggccatcgagatgtgtaacatctattccggtattctttccgggaccatggatgcgttcgcgtctgtaatttccaataacctgaatatcgttatgaaaattctgaccgcgatcacaatcgttatggcgataccaaatatggtttttagtttctatgggatgaacgtaaccggtctgccgtttccggtctggtgggttccggttgtcatatcaatcgtgattgcgggaattggcgcctttattcttgtgaaaaaggatatgttccattgatcatttcgtttgtccatgcggacggacacaaaaagaacggaccttttaaggtccgttctttttgtgttttacttcttatcaagaacggacatgccggataaatcccggcatgtccgtttttgcttcacttacagcccgtgacaggcgtcgcattcaccaacctcgccgacgataggcgtcggatcgacgccgtttttgcggtaatagtcggacagtgccgctttcaccgcctgttctgcgagcacagagcagtggatcttggaggcaggaagcccatcgagcgcctcgacaaccgccttgtttgaaagcttgagcgcgtcctcgatggtggagcctttgatcatatcggtcgccatggagcttgtggcgatcgctgcgccgcagccgaacgttttaaacttcgcgtcctcaatcacgccgtctttgatcttcaaatacattttcatgatatcgccgcatttcgcgttgccgacctcgccgatgccgtcggcattttcaatttcaccgacattgtgcgggttggcgaaatgctccaaaactttatcagaatacagcatatccaacaatcctttccgtatatacaggtttatagatcaatcgttttgcgccccttctgaatatcctcccagagcggggagatatcccgtgtgcgggcgacgacggatttaaccgaatcaatgatatgatcaacctcctccggcgtggtccagtcgctgatggtgatacgcagagatccgtgcgccacctcatgagagagaccgagcgccaaaaggacgtggcttgggtcgagagatccggtcgtgcaagccgaacccgaagacgcgcagacgccggccatatcaagaccgagcagcagcgcctcgccctccgcgccgacaaacgacaggttcgcgttgccggccagacggcgctcccggtcgccgttcagacgcgacatcggcagggtgagcagttcgtcgatcattttgttgcgcagcggcgtgaccttggagattttggcaggaatatcggcgcaggcgatttccatggcacgtccaagtccaatgatcgacgccacattttccgtaccggcacggcgtccgcgttcctgttctccgccgtcgatcagatttggcagtacaatcccttttttgagatagagtgcgcctacgcccttgggcgcgtggattttgtgtccggagagggagagcatatcgatgttctgcgcagcgacgtcgatctcaatattgccgacggcctgcaccgcgtcggtgtggaaccacacgccgcgttcgcggcagagcgcgccaatttcgggaatcggcatgatagtgccgatttcattgttggcatacatgatcgatacgagcgccgtatcaggacggatggcgtcggcgacctgctgcgcagtgatcaggccgttgtggtcaaccggaagatatgtgacctcgaagccttctttttcgagcgccgcgcatgtgtggagcactgcgtgatgctcaaacacggttgtgatcaaatgtttctttcccttggcggcgagcttgtgcgcagctcccttgatcgcccagttgtcgctctcagagccgcagccggtaaagtagatctccgcaggctgcgcgccgagcgcggcggcgacctgtttgcgcgcgtcctcaatggcgaagccggcagtgcggccgagttcatagatgctcgaagggttgccgtaaccttcggtcagccagggcatcatcgcgtcgaggacttcctttgaaatctgagttgttgcagcgttgtccgcgtaaacaaactgtttcatatcaatatcaccatcctgttatggagttattatgttgctttataaatcaattgtatacctttttagtgtcattttcaagaggggagcgcaaaattttacgtttttcacctaaaacgcgcaatggccgcgacagccagagcgtcgcagcgttcgttttccggatgaccggcatgtcccttgacccagtggaatgtgaccttgtggcgtccgagcagagggagcagcagcttccacaggtcggcgtttttggctggttctccgggggcgcgcatccagtttttcttctgccagccgtatacccatcccttggatacggcgtccgaaacatatttggagtcagttgtcaatgtaacgctgcacggctccttgagcgccgagagcgcctcgatgaccgcggtcagctccatgcggttgtttgtggtctgagcctggccgccggaaagctccttttcatgttctccgaagcgcagcacggcgccccacccgccggcgccgggatttccggagcaggcgccgtcggtaaatatttcaacctgtttgatagttcccgcctccaagccgtcgattgtatcggcggacctgctgcgcagtacgcggcagaatcctttccttattgtatacgattttgctccgtgatacaagcccccgcccgccaaaaagaggaagaacatgaaatttaaacgtatggcaagcgccggtattaaagcgtgaaaaattcgtccatactaaatgaaaagtcatttaaagctgcctgtaaaaccgttttttaaaaacagaaccgctttcttttggaagtgtccttaagtttgggcagcctgtatttgtattgtggagggtcatcatgaaagcagtcatcatggcgggcggccggggcacgcgcctgcgtccgctcaccgaacgctgccccaagccaatggcgcgcctgtgcgggcggcccgttgtggaatatattttggagctgctcgcgaaaaacggcgtgactgaaagcgttctgacgctgcaatatctgccggatcaaatcgtttcacactttccggacaacagcttcgcgggcgtcgcgctctcattttgtgaggaagcgcagccgctcggtacggcgggaagcgtcaaaaacgcggccggccaaatcggggaagatctgcttgtaatcagcggcgacgcgctgtgcgatttctcgctgcgcgaggcgatggatcagcatgcagcgcgctgtgctgacgtaacaatcgttacggcgcgcgtcggcgatccgcgtgaatatggcctcgtgatcgcagacagcgacggacatgtgacggggtttattgagaagccgtcttttgcgcaggcgacgagcgagcttgcaaatacaggcatttatattctgtccccgcgcgccgtggaaatgattccggacgggcaggtttttgattttgcagccgatctttttccacgtatgcttgagaaaggcatggcggttgattgctgcacattgtctggatattggtgcgatatcggggatctggaggcgtaccgccgcgcccaggctgatttgctggcggggcgcgtagacgcaacgcttcgcggccaacgcgatgagtcaggcaacgtgtttgcagcgcgccgcccgtcaggccgctatgaaatagaagcgcctgtctatatcggcgagggggtcagcattggggataacgccgtgatcggcgcgggaacggtgcttgacgacggatgcactgtcgccgcgggcgcggctgccaagggaagcatccttttgccgcacagcctgttgtcggaacgggcggccgcagtcaacgccattgtctgtacaggcgcggcgctgaaaagccgggcggcgctgctggatggagcggctgtcggggaggatgctgtagttggcgcgggaacgatagtccgcgaaggcgtgcgtattgcgggcggtgtgcgcatccaggacggtacggccgtttcggggcatatcacggaacgcggcggcgcggcatgcacatttgacgacgaggggctttgcggcgaaatcggcgtggagctgacgccggaattggccgcgcgtgtcggctgcgcggtcggtacggtggccaagggccgtcccgtcggcgttgcggcggctcgctcgcgcagtgcgcgcgccctgtgcgacgcgctgatcgcgggcgtgcgttcgaccggcgcgtccgtgctcgattttgggtgcgtgtttgaagcgatgtttggttttgcgatgggatacaacgcgctgacgctcggcgtttatatcagcgccggggaatcgggcgcgatccgtgtgctgtgcgacacggggctgcctgcgccgcgccgtgtcgaacgggagatcgagctgatgctcgcgcgcggcgaatttgcgcgcgcgccgcgcgacggttttggggaccgcgtggatatgtccggcattggcgtcatgtatatgaccgaattgctgcggctggcgccggaggggcttgaagggatgcgcgcgcatgtgtcctgtcccgatgaatcggtcggccgcctgttgtcggacgcgctgcaaaagcttggctgcgagcgggcgccgtccggcatccggctgatgctttctaccgacggccgccgcctttcgcttttcgacggcaatgtgcgcattggatggcgcagggctgtagcggcttactgtttgtcacagtttgagcaggaccgcgatgtggctgttgagaacgactttccgcgcgctctcgatgcatttgcagagcagcgcggtcatcgcgtctatcgttaccttttgtgcccggccgacggatctgacgccgagggccgccgcctggcagcgcagcagcagagcgcgcgcgacggcctgatgctggcgattcaattgcttggatatatgaaacggcatggattcggcctggaggagcttgaccgccagcttcccggctttgccgtcgaggagagtgcggtcaagctcgaccggccgcctgcgcgcctgctggagcggttttcacaggagcgcgccggggagggcgttgttgtgcgcggtgaccgcggtgtggttttgctgcggccgcgaaaaaacgggcgggaaatccgcgtgtttgccgaggctgccaactgggaaacagcgcgggagttgagcgcggacattgcgcgggagctgacggacctgcttgacaaggacgggaaaaaagagtaaactatattatgacattttgtgtccggttgataaaaatggaaaaaggtccggcgataaaccagcatacatgctggcaggctctggggcctttttaatggacaggggcggagccgccgcgcgttaccgcggcggccgcgctgtctgattaaaaaaggttcatataccgcctatcctttcagcccgcgcttttgcggctcccggcgtattgtggaaacccgggacagccgtgtgatcggaaccagcggggggatgggtttgtgttttgcagcgcctgagagctgatcaggggatcaaaaaggataattttcctcataagcagtggtgtccgcagtgcgaaatgtgtcggaatcccaatgggtgacacagcttttgccctgggcctgtttgttatgggtaacagcagaagcctttttgctctcatggcttgtttggaaactgagaagatacagaaaatggtgttttcggattttgacagcctcctctgcgctccaaccgtccggattttcaaattagaacctgtatacacagccggagggtgccgggcagaaaaagttttatgcgcgatcaagcaaaatttttgcaggcgggctgtcgcccggcaagaaaattttacgccaagcgtgggcaaaaggcccgcctggacaacgcttgacgactgtgaatacaggttctcagattgtgattgcagcaatacggaggtatattttgtgacagatgataagaaggtcggcggaaagctgacagaggagcagctcagtatgggtgtggaggcgcttgaaaagcgttccgtggtggagcgcgccgcgccgcgaaagaaaaagacccgccagccggtcaaggaaacggctgccaggctgctccagaaggtaacgccggaacaggctgaggagacgtccgccaagccggcggcaaaaaagagcgcatcccgtgcggagaagccggccaagaaggaaccgcagaagcgggatgcggcaaagaaagagccggcccgcaaggagccggccaagaaggagccgtctgttaaaaaggaaaacggcgagccgcgtcagccaaagcgtgggcgcaagccatccccaaaggcgtccgccccgatcggcgcgacgatcgagctttccgaagcgggaaaggcccgccaggagaaagcggcgcgcccggccgggcgcgccaagaaaagccgtgtaaaggagcagcgtaagacgccggtgcgcatcattccgctcggcggtctgttggaggttggtaagaacatcaccgtttacgaatgcatgaacgatatgttcatcgtcgactgcggcatgacctttccggatgaaaatatgctcggcgtcgatctggtgttgccggatttcacgtatgtacagaagaatcgcgacaagctgcgcggcatcgtgatcacacacggccatgaggaccatatcggcgcgctgccgtactttttaaaacagatcaacgttccggtctacgcgacgcgccttacgctcgggctgatcgagaacaagctgcgggagcacggcctttatgggaaggtcaagctggtgcagatcgcaccgcgtgagacgattaagctcggctgcatggaggttgaatttatccgcgtcaaccactctatccccgacgcggtcgcgctggcgatccacacgccggccggcgtcattatccagacgggcgactttaaaatcgactacacgccgattataggcgatattatcgatctggcgcgttttggcgagcttggcgggcagggcgtactggcgcttctgtccgactccaccaatgcggagcggcccggctttaccccgacagaggtcacggtcgcggacagcttcgacaagctctttaagcaggccggacacaagcgtatcatcatcgcgacattctcctcgaatatccatcggatgcagctcatctgcgaagcagccgcgaagcacgggcgcaaggtcgccgtttccggacgcagtatgatcaacgcggttgccgtttcaacggagcttgggtatctcaagccgcccaacggcgttatgatcgatatcgatgatatcaaccgctaccgccccgaagatatcgtgctgatcacgacgggcagccagggggagccgatgagcgcgctttcgcgcatggcgtcgaacgatcaccgcaaggtgacggttacgcccgacgatttcattatcatcagcgcgacgccgatccccggaaatgaaaagacggtcggacgcgtcgtcaatgagctgatgcgccttggcgcggacgtgatttatgagcgtatgtacgaggtgcatgtatcgggccacgcctgccaggaggaactgaagatcatgctggcgctgacaaagccgaaattctttttcccggtgcacggcgaatacaagcagctcaaacgtcatgcgtcgctcggccttgcgatgggcatcccgacggagaatatctttatcggtgaaaacggccatgtgtttgagcttgacggcgtttccgtcaaaacaggcgagatcgtgccgtcgggccgcgtgctggtcgacgggcttggcgtcggcgacgtcggcagcattgtgctgcgcgaccgcaagcatctcggcgaggacggtttaatcgtcgtcgtaacaacgatcgacgggaccagcggcgaaatcgtggcaggaccggatattatttcgcgcgggttcgtctatgtgcgcgaggcggaggatatgctttcagaggcgcgtgccatcgcaaagcagacggttcaggactgcgtgggcggccgtatgcgcgattggggcaacatcaaaacgcaggtacgcgacgctctgtcgtcctatttttacggacgcaccaagcgcagcccgatgatcctgcctgtgatccaggaggtttgacagggcgcgcctgttgaatattgcagcgcggcgcggcaaaaaaggaaggccggggaccattggtccccggccttcctgcgcttttcaataggacagcgcgggatcaaattttgcggcccagagcgcgccgagcgtttccaggtccgatttgaattcctccgatgtctgatcgggtttttgctcgatttcctcaaggatttcaaaggtgaaagcgtcctttccgaacgccttccagtcggcctgcaatttggcgtagacacagttgtccgtattttgtgaaaaggcgaagcggttttgcgtgccgcgcggattggccggcgtctcgagaagataccggccgttgatcgaattgcggatgaccgttacgcccgcgatcagagggcggcttttataggcggcgatcagttcttttttgcgctggtccatttttaataccccatttccttcagaaggcgtgcgagaacggcgaagcgttcgcccaacagttcgctgtcacgcccaagcgcgtcggcaaacaggcgtatatcctccttgatcatcgggttatcggtgcagacgcctactgtcatcgcgtcgccctgcaagccgatgcggccgatctgcggatgatcgggattgaaaaactgagcatggcggtagccttcgtcgcgaaaatactgctgcgtacggcagatcaggatcgcaaggtcgatcacacggtgaagcggcagctcctcggactggcgcgaccatttttcgcctgtataccgccaaaccttggctgaaatatcgacgcggccgcggtcgttccactgggcaaggccgagcgaaagccccttcgcgtcgctttcataagcggcccggccgtcaatacggtcgtacccctgtgcgacgacgacaggcttatgcttgagtgtggttggaatattcatctgtataccttctttataaaattagtaatttactaaattagtaaaaacaatatagcacaatcggatggaactgtcaagctggctgaacaaaaaaccggctccgcagcagcggaaccggaatgtatcaactgtcgatataggtcaaaaacgcttcgggcggacgcgccgcgacctgataaagcggcgtaccggaagcggaattttcaatgcgcagaagaatacgcccatcctgaaaatacacaaaatagatcagctcatttttatccttgtcaaccgggccgatcgtgatttcatacagcgcgccggacggatccaaaacgccgccatacgcttcagacggggcgaggatacctgccagttcgtttatctgcggcgcataatcgtccgctttgcgcagcgggccttccaccgatttcacaagtgcgccgcgcacgccgtcctgcatctgatagatgcggatataaaagtcttggcgccgtgtctttcccgattggaacagcgcgaaaatgataacgagcagggcgacaggcttgagccaggtgttccgcttcataaacgctccttttatcaggcgcccttatacgcttgcaaagcgcgccggtttgtaagcctatgatagaccgtgcggggcttcttgtcaactcagacgcggcccgcttaaatcagattgcgcagcagttctcctccgatttgcagagcgctttgcagcgtatcggtcagatgcgtcatatcatgcagatcgatatacttgaaccagccgcttcccatatattcatccgttattttctgctgcgcccatacctcatacaatccatccgccctctggtgaatttctattttgtaacttttgtcgtcggaatactgttcataaaccggccgctccctcatacgcgccctcctgacatgaatttgatgcaaacgccgcttcacatggttcgcgccgcccgactgcacgcgttgcgtactgggaaaaacgctgcatacagtataacacaaaaatcctcctcccgcatagtggaaaaaggggcaggttgtacagatttggattgcaacaaagaaagcattgtgttataataaaaactgtatggttatccgaacgaagcgcggacggagcaggcaagcccggcccgacgacattgttgacaggcgaggttacgaagtgaagaaaagtacaaatccgtttcgttctctggcgtatattgcggttggatgctgtctggcgatcacgctggcggcgctgtttttcaacctgcggctgttttacgtctgtcttggcgtgacggttgcgtgcgcagctctgcttatctatctgatgcgccgcatcaaaaaggacatcaactcccttttgaccaaaatggggcaggcgctgaccacggtgcagcgcgaaaccatgcagacctttccaattccggtgttcgtctgcggcgagcagggggagatcatttggtgcaacgagcttgcgcagtcctccgtgctggagcatgaggagacatacggccgcagcatttacacgatcctgaccggggcggatataacgcgccgctgcccggagggcggttacgaggtcgattataagggacgccatttcaccgcctatgtaacacatgcgtccgctgagaacgacccgctgtatattgtctacttctttgaaaataccgagctgaagcggtacgcgcgcgaatactttgagacgcgtccctcgatcatgctgctgctggtcgataactacgaggagcttcagcagaacatgaaggacaatgagcgcacgcgcgtgatggggcagatcgagtatacgatcagcaaggctgtgacggaaagcggcggcctgctgttaaagacagagcgcgaccggttcaccgtcatcattgaggagcgcaatctgcgcggcatcatttcgtcgcgtttcccgatattggagcaggtgcgcgccattgagacagaaaacaagatggtcgcgacgctttcaatcggcgtcggacgcgacgcggccgaccttgaggagagcgagcggtacgcgcgccaggcgcttgatatggcgctcggccgtggcggcgaccaggcggctgtgcgcggcgcgtcgggctatgaatttttcggcggcgtttccagcgggacggagaagcgcaccaaggttaaaacgcgcatcgtcgcaacggcgctggcggaattgatttccggaagcgacaatgtgcttgtgatggggcacagggcggcggatctcgactgcttcggggcgtgcgtcggcgtgatgcgcgcggcgcgcctgatgggcaaggaggcgtatatcgtcatccggcgggacaagtgtctcgtgcagcaggaatatgacaagcttctggaaaacggctttgaggggatgctgctcgagccggaggacgccgagctgctcgtcacgcgtaaaacgctattggtcatctgcgacacgcatgtgcgcaatattttggaatccactcagatttttgacgcatgccgcagcgtcgttgtgatcgaccatcaccgcaagatggttggtcatatcgacaatgccgtgattttttatcatgagccgtatgcgtcgagcgcgtcggaaatggtcacagagcttgtgcagtattttggtgataaactgcgtttaggccgtctggaggcggaggcgctgcttgccggcattatgctcgataccaagaattttgtcatcaagacaggcgtgcgcacttttgaggcggcggcctatctgcggcgtatcggcgcagacaccgtcgaggtgcgcaagctgttctcctcgacaatggaggcgtaccagcgcaaagcgatgttggtcgcccatgctaaggtataccggggctgcgcgatcgccgtgtcgcccgaccacgacgcgcctgacatccaggtgacggccgcgcaggccgcggatgagctgttgaatatcagcggcgtgcaggcgtcgtttcttgtgttcggcctaaacggcgggatgtcgttttcggcgcgcagcatgggacaggtcaacgttcagatcatcatggaaaagcttggcggcggcggccatcatacaatggcgggggcgcagcttgccggcatcgatggagataaggcatatgaactgctgattgcggcgatagactcctatttcgaggaaaacagccgcaaataaacagcgtaattcgattggaggaagcaaacatgcaggttattttaaaacaggatgtcaagggcagcggtaaaaaaggggagctggttaaggtttcggacggatatgcgcgcaatttcctattgccgaaggggcttgcggttgaggcgaacgcacaggctttaggggagatgaaagccaaacaggcctccgccgcgcataaagccgctgtggagcaacaggcggccgaggagctggcatcaaagatcaagggtcagactgtcaagctgtccgccaaggccggcgcaaacggaaagctttttggctcggtcacatcgaaggagatatccgaagcgattgagcgcgcgttcggcgcttcgatcgataagcgcaagattgttctcgacagcgatatcaaggcgtttgggagttataccgtgcaggttaagcttcatccgggcgttacggcggacgtttatgtcgtcgtcggtgaaaatgattgacaagctgcgcgcaccggcgcagacacgccttgcggattaaacaggcgcggcgcctgcgcgcagaaggcccgtaaaaggcagaaatcaatggcggcccgcgcgccgcttggagggtgttttgttggctgatttggaattgggcgagtatggccggcagatgccttacagtctggaggccgagcaaagcgtgctcggcgcggttctgatcgatccagcttgctttgcgctcgtgatggaaagcctgcgcgcggatacgttttaccgcccgcagcatcgtcagatttttgaagtgatgtccacgatgttcaatctgaacaaaacgatggactttattacgatcctcgacgcggtcaaaagcgagggcatattcgataccgacgaggacgcgaaaatttacctgaccaatctcgcgcaggtggtgccttcggcggcaaatgtcgaagcgtactgcaaaatcgtgcgtgagaagtattatgtacggcgcctgatcgaggcgtcgcgcggtattattgaaatggcgtccgattcgcaggctgaatccgacgtgctgctcgattcagcggaacaaagcattttcgatatccggcagggacgcaatacaagctctttcaagcatatccgcacagccattaccgagacatatgaggtgctccagcgattgtccggcgaggaccgggacaaataccgcggtatcccgaccggtttttcaatgcttgaccgcgtgatcaccggtcttaaccgcacggatctgattttgatcgcggcgcgtcccggtatgggaaagacgtcgttcgcgctcaacatcgcggagaatgtcgcgacaaaaacggataaaaccgtggcgattttttcgcttgaaatgagcagcgagcagttggcccagcggcttttgtcgtcgcaggcgtccgttgaggggcagctgctgcgcacgggtgaattgagcggtgacgactgggtgcgcatcgcgatggcttcgcagacgctctccagagcggatatctaccttgacgacacgccgggcatcaccatcggcgagatgaaggcaaagctgcgccgtctgcgaaaggtcgaccttgtgatcatcgattatctccagcttatgtcgtccgggcggcgttcggaaaaccgtgttcaggaggtcagtgagatcacacggaacctgaagatcatggcaaaggagctgaacgttccggtcatcacgctgtcgcagctctcgcgcggtccggaatcccgctccgaccataaaccgatgttgtccgacctgcgcgaatccggctcgatagaacaggacgcagatatcgtgctgcttttgttccgcgaggattattatgcgcgcgaggatgccgaggaacgcaacgttgcaaactgcgacgtcgccaagaaccgtcatggcgaggtcggcgttgtaaagctcggctgggacaaccgttatacaagatttacgaatttggagctgggacgcgatgaaccataatgcgcgcgcgacaattgaagaattctccatgctggcgcagggtgacacagtggccgcggccgtatccggcggggccgactcggtcgccctgcttgattttttatgcgcgcagctcgaccttgggctgacggtgcgcgcctgccacctcaaccattgcctgcgcggcgaggaaagcgaccgcgatgagcagctcgtgcgaacgatgtgcgctcagtatggcgtggcgctcgatgtgcggcgcgtggatgtgcgcgcgctggcgcatacgcgcggcctttcgcttgagacggccgcgcgcgaagcgcggtatgcgttttttgaggaggtagcgcgcacgcatggctgcaagatcgcaacggcgcacacgttgtcggatgcggctgagacagtcgttttgaaccttgcgcgcggcacggggatcgcggggctttgcggcatcccgccggtgcgtggcgacatcgtgcggccgctgatcggctgcacgcgcgcccagacagaggcgtactgtgcggcgcatggcctgtgctatgtgaccgacagcaccaatctgacggatagctgcacgcgtaatcacatccgccacaatatcctgccgcagctctttcgcgtgaatccaggcgcgctggaagcggtcggccgcatgaccgcggcgctgcgccgcgatgcggactatctgtccggcgcggcgcgtgaggcgggcgcgcgggcggcgcgcggcgaaggttatgaccttggggcgctgcgcgcgttgcatcccgctttgcgggcgcgcgtcatcgcggcgcttttggaggggggcggcgcggagcgttcggcacagcgcatcgcatccattgacgcgatgcttgagggcgggcggcggcgcgttatgcaggtcgggccgagtctctatgttgttgcggatggcggcctgctgtgtctggagcgccgcaaaaagacgccgctggaaccaatagagccgcgcctgctgcggcgtgaagcgatcgatggagcgcggatttcactgggcgatggaaaagcggttgaattttctgtggtaaactgtgcagattatgaaatttttgataataatggcggaaggctcttaaaaaatgccgctgattatgataaaatagataatagcatttttctgcggtcccgacaggcaggggaccggatacagcccgctgggcgcggctgtacaaagctgctgaaaaaattgtattccgagatgggcgcggccgaccgagaacgcctgtgcgtgctggctgatgagaacggggtgttctttgcagagggcgtcggtgttgacgaacgcgtccgggtggacaaagcgaccacacatatcatgctgatcgctttcgcgcatgacggcgcggacggtcgcatggcgccggaggaggaaacagcatgaaaaacatggagcaggatattttaaaggttttaatcgaggaaaatagcatacaggaacgggtacggtcgcttggagcgcagatttcgcgcgattatgaggggaaaaaactgctcgtactcggcgtgctcaaaggctcgtttgtgtttatggccgatttaatccgtgcgatcacggtgccgtgtgaggtcgaattcatggccgtgtcgagctatcgttccggcgtaaaatcgtcgggagtggttaagataatcaaggatattgacatcaacccgcttgactataacatcctgatcgtcgaggacattcttgacagcggcctgacgctcagctatttgcgcgatttgctcatgcagcgcgacgcttccgatatcaaaattgccacgctgcttgacaagcctgcccgccgtgtggccgacatctcgcccgattacacctgttttgaggttccggacgaattcgtcgtcggctacggcctggattttgcggagcgttaccgcaatctgccctatgtgggcgtgctcaaaccggaaatttatgaaaaataaatagaatatggcgctgtctgcggcctggcggccgcggcagcccggccgcattggggggcggccggcgggacggttcgcgtcccttggtacgcaatgatttgacaggagtgaatctgatttgaacaaaaaaacgaagggtgtcggcatctggctttcgatgttcctgctgctgatgctcatggcagtgctgttgttttcttccatgaagcagccagcctcgacggaaaaatattccgatgtgcttggttacttccagcgtctggaggtccagtcgtttgtattcgacctgggaacgggcgatctggaaatgacatttacagacggcaaaacaaaggcttaccgtgtgccgaatgtaaacctgtttatcaatgatgtctatgccgagcggtacgatggctcggataactatatacagcagtacaacaaggcgcatccagacgcgccgatgcagtacgatctgctgccgattaagacgactccctggtgggtcagtctgatcccaacgcttgtgctggttgggttattggtgttcttctacttcatgatgatgaagcaggcgcgcggcggcggcacgagcggcgtgatgggctttggcaaggcaaagcccagacaaccggaggagatgccgaaggtgacgtttaacgatgtcgccggtgcggatgaggaaaaggaggagcttgtcgaaatcgtcgagttcctcaagaatccatcgaaatttaattcactgggcgcgcgcatccccaagggcgtgctgctgatgggacctcccggaacaggtaagacgcttttggccaaggctgtggcgggagaggctggcgtgccgtttttctccatttccggttctgattttgtggagatgtttgtcggcgtcggcgcatcgcgtgtgcgcgacctgttcgagcaggcgaagaaaaattcgccgtcgattgtctttatcgatgaaatcgacgccgttgggcgtcatcgcggcgcgggactcggcggcggccacgatgagcgcgaacagacgctcaatcagctgcttgtcgaaatggatggctttggcaccaacagcggcgtcattgtcattgctgcgacaaaccgccgcgatatcctcgatccggcgctgctgcgtccgggacgctttgaccgccagattgccgttggctatcccgatatcaagggacgcgaggcaattctgcgcgtacacacgaaaaacaagccgattggccctgacgtgaatctcaagacgattgcggcttccacagctggttttaccggcgcggaccttgaaaatctcacaaacgaggcggctctgctggccgcaaaaaagaaccacaaggcgattaccatggttgaaatagaggaagcgacaatcaaggtgatcgccgggcctgagaaaaagagccatgttgtgacagaaaaggataaaaagctgacctcctaccatgaggcgggccacgcggtctgcacctattatctgccgacacaggatccggtacaccagatttcgattgtgccgcgcggtatggccggcggttacacgctttctctgcccggcgaggataagacgtatgtgaccaagcgcgaaatgaacgaggatatcgttacgctgctgggcggccgtgtcgctgaaaagcttgtgctcgacgatatctctacgggcgcctccaacgatatcgagcgcgcaacaaaggttgcgcgcaacatggtggtgcggtacggcttttctgaaaagctcggcccgattgtctatgggcatgacgacaacgaggtattccttggccgtgacttttccagtacgccgagttattcggagacggtggctgcggagattgacgctgaggttcgcgagattatcgacaccgcgtatgaacgcgccgtcgatattctgaccgagcatatggggcagctgcatgaggttgcgaagtatctgtttgagaatgaaaaaatggatgaaaagacgtttgccgatatgatggctggcaagaacaccgtcaatctggaaaaatccgcggacagcacggagcaggacagcgcacagaccgctgtcagcgtggaggaagccgcggatgaagctggtcaggatccaacggtttaagcgggagctgctgtgacaaatcgggcggcgatggttttcagggcgcggtttgccggcaaacccaattgtagcggaggttatgaggatgctgtttgataaaattatcactctttcgctgaaccctgtcgctgatattaccttgtatgtggaccgatatgagatgggcggagaaaacaccgtgacaagcgagctgtatgacgcggctggaaaagcggtcgatgtttcgcgtgtgctgcgcagctatgagattgcgaatacggctctgattgtggctggtcaggaaaacagcaaacggtactttgaacggctgcgcgatgagaatgttgccacgcgtgtcatttatatggaggggcgtatccgcgaaaatttaagcatcctcacgcctgacggaacaatgacgcgcattattcgaaaaagccccaagatcaagcaccacaccatcgatgagctggaaacggcgctttcggaggaaatccggccgaccacacttgtcgtcgtcgcaggtgtgatgccggacggcatcacagatgaaatcttctgtgagatctgcgcgtttatcaaggagtgcggcggaatcatcgcgcttgatacgaaatccgcgacgctggaaaatattgcacagatcaagccatgggtgattaagccgaactatgaggaactgtgcacgcttgtaggccgtccgcttgaaacgaccgaggaaatgaaggaagcagttaaacaggtggctgacgcaggggcgaagcatgtgctggcaagctttggcgcggagggtatgatctatacggatggcttggttacatacaaggccgatgttcccgagctttccgagatcaaatcgactgtcggcgccggcgacgcggcgttggccgggtttatcatcgcgcacgactataagtacgaccttaaaaaatcgctgcagtttgccgctgcgttcggcacggcttcctgcctggtggaagggaccaatccgccccggcggatatctgtcgcgatggtcaataaccaggtgtctgtttacagcatttgattttgaagccaaaaaaatccggacgtggtccggattttttcagaagggatatgcgatatgaaagaactgcttgtcgtcgttgattatcaaaatgactttgtatctggaagcttgggctttgagaaggcggcgtcccttgaggatgcgatctgccataagattgaggcgtaccgttcgcgcggcgcggacgttgtttttacgtttgatacgcatgacgcggattatctgaacacacaggagggaaagtgtttgccggtcgtgcactgtgtgcgcggcacgccgggctggcagctctgcggacgtgtcgccggttattgcggacctgatacggtctgtttctacaagcctgtgtttggttccaggcagcttgccgattatgcgggcgcgcagggatatgatgctgtggagttatgcgggcttgtatcaaatatctgtgtgctttccaatgcggtgctgatcaaggcggctctgccggaggcggttgtgactgtcgacgcgcagtgcacatcctgcgccgatgaatcgatgaatcaaaaggcgctggatgtcatggaagggctgcaaatccaagtgattaatcgctgatcgtttctcgtaaatcaggatacggaaatcagggagcagccgactggaggtgagcggatggtctgtaaaaaatgcggcaggaacgtcaagggcgatttcaaattctgcccttactgcggcgaacggcttgtgagcgattttcacgatcattacagtgagttggacccgccgtttctcgtccaggaaccggacggacctgatacagcgtctgatttttatacatatgctcctgatgagcaggagccggatttcggggcgtttgacgattatgacgcatatgaacaggaaatgccgcatggccgtgaggcggatgatgattcatactttgtctatcagccgcaggagccgccgcctgggctgatctttcatgcgcctgatccggacgatctcaaggaggaacgtccggcgcgcagcgggcggcgttttgctgaaaagcgcgcgccgggattggtgttcaagctgtttttaatcctcttgattttggcgttggccgcgggcgtcacaatttttggatactatctgctgcgttctcctgcgccgtttgaaagctttgatctggcggcgacctttgcggtgtttcctcctctttaagcatagcgggagtcatttacgcagggtaatttggacaagcctattgaaaaaagacaatacacagtgtataatatagtcagccgcatgtgaatccgtccggagatacggaggggggcctttcggggcagccgtgggacggccatatgtgcagagttgggcggagccgcacgctgtgaggctccgcctgctgttttttggaggtgcaaaatggaaagaacggttttggttgcaatgagtggcggtgttgacagttcggttgcggcacttctgctcaagcggcagggatatgaggtggccggcgcgacctttgagctgtttgacggctgtccggaaggaaatgtccgtgacgcgcgcgccgtctgtgactgccttggaatccggcattatgtatttgattacagggctttatttaaaaaacgtgttcttgaacattttgtaaacagctatctgacggggaaaacgccaaacccatgtgtcgcctgtaatcgttcagtcaaattcggcgcatttttacaggatgccacgcgcttgggatatacgcatatttcaaccgggcattacgccagcgtcgcctatgatcagacagccggccgttattgccttcagcgcagccggcagacacgcaaggatcaatcatatgtactgtatcatctgtcgcaggagcagctttcacggctgctgctgccgatcgacggctataccaaggacgaggtgcgggcatttgccgccgaagccggcttgccggtccaggcaaaggctgacagccaggatatctgctttgtaccggatggcgactatgccgcttttattgagcgatataccggccaggcaagcgaaccgggaaattttatcgatgacgccggccgtgtgatcgggcgtcaccgcggcgtgcttcattatacaatcgggcagcggcgcgggcttggggtggcttttggaacgcacaggtatgtcagccgcctggatccaggcgccaatacggtgacgctgtcggatgaatcgtcggtgttctgcgatcagctaatcgcagacgatcagcggctgatcgcgtttgacgcgcttgaaacgccgctgcgggcctgtgcgaaaatccgttatgcgcatacgcccgcgcccgcgacaataactatgttggagggaggacgcatacacgtccggtttgatacgcctcagcgcgccattacaccgggacaggccgttgttttttatgacgatgaccgtgtgctcggcggcgcgacgattgtcacagccggttgatatcctgtctttttcaataagcggcggatatgcgaatttttcgttccgtgagggaggagtttcatgaacatctttgaaaagctctttgcacaaacagaaattcccaagctgtacccggtacgttttacccttcccagaggcgctataaagcgggaagaaatcgaaaccctgctgttcagggaatttacagaaaagcggttggattgccaaatccgtccgagtatgtcggtcgcgattgccgtgggcagccgtgagattacaaatcttgcggagattgtcaaaacagtggtggagtttgtaaaacgctctggtgggataccatttatctttcctgccatgggcagtcacgggggagctaccgccgagggccaactggaggtgctctccggctacggtgtgacagaggcggctatgggctgtcctatccgctccagtatggaaacggtacagatttccactacggccgtcggcctgcctgtacatatagacaaatacgccgatgaagccgatggaattattgtcattggccgaatcaaaccgcacacagattttcgcggaaagtacgagagcggtttgatgaaaatgctgacgatcggacttggcaagcaatgcggagctaatttatgtcattccatgggtatgtcgaatatgccggaaacgattgaagcttatgcgggggaagtgctgcgcctgaaaaatgtaatctgcggcgtgggaatcatcgaggatgcattccatgccacctaccggctcacggttgtacccggcggagagatcgcggatcgggaaccggcgcttttgtctgaggccaaatccctgataccgtgcatcccgtttcggaagatcgatgtgcttgtgctggacgagatcggaaaggatatcagcggcgcgggcatggacccaaacgtaacaggccgttcccaggcaatgggcgtcagccagccctttgtggaacgcattgccgttttggatttaacggataagtcgcatcataacggatccggcatcggcggcgccgatgtgacgacccaacgcttcgttgataagctggatttggagatcacctatcccaactgcatcaccagtcatgatctcaatggcatgaagatccctgcgattatgcccaatgaccggctggctgtgaagctggctttaaatacctgtatcggcagcgagcctgctttgggatatcgaatggtgtggatgaaaaacaccctgcacctcgatgccttccatgtaacaaaggccctgctcccggaggtggaggaaaatcccctgctgcaacgtgcaggagagggtttttatccccgcttcgataaaaacggcagcgtcattcatgaatgacgctgccgtttttagttagacgcgcttgcagacagcggcgcgtccagggaaaaaagatcagaatgtggatactgaatgctgttcggtcaatccagctcgacagcaccggtgtaaagctggtaataacggccatgctctttgagcagatcgtcatggctgccgcgctcaatgatttcgccctgttcgagcaccatgatcgcgtttgaattgcggacggttgacagacgatgtgcaatgacaaatgttgtgcgtccctgcatcagccggtcgaggccatgttcaatatggcgttccgtgcgtgtgtcgacggagctggtcgcctcgtcaagaattaaaattggggcgtcggccacagcggcacgcgcaatattgagcaattggcgctgcccttggctcaggttcgcaccgtcgccctcgatcactgtatcatagccatgcggcaggcgggagatgaatgaatgcgccgaggccagttttgcggcgtcctcaacctcctggtcagtcgcgtccagctttccgtagcggatgttttcacgcacggttccggtaaaaagatgcgtgtcctgcagcaccattgaaagcgagcggcgcagactgtcctttttaattttgcggatatcgatgccgtcaattgtgatgacgccttctttgatatcataaaagcgtgtcaaaagattggtaatcgtagttttgccggcgcctgtcgacccaacaaaggcaattttttgcccgggctttgcatacagggagatatgtttgaggatcgtcttatcctcgttataaccaaaagtcacgtcctcaaatttgacatcgccgcgcaccggaacgcgcgcggacggatggccggacgcgtcgtattgctgccagaagaaggcgccgttttcatgaaccaggtccgccgcgtgcggcggatcggggtcctcggccggctcgcgcatcacctcatggatgcgttccgcgcctgcgatcgctgtgataacagcgttgtattggctcgaagcctcagtgatcgggcggctgaattgacgcgttagctgtaagaatacgacaagcccgccgacgctgatatgcccaaagacagcaagcacgccgccgatcatggcgacaagcgcatagttgatcgtggaaatattcatcataaccggcatcatcagaccggaatagctctgcgctgttgttgcggtttgctgcaaatccccgttgagccggtcaaattcagcgagcgcgtccggctcatggcagaacaccttgacaaccttttgtccggtaataatttcctcaacatatccgttgacgcgcccgagatttgcctgctgtgcgacaaaatatttactgctggcgcgcatcaggcggccggcgacaaagaacatgaccggcgtcatcagaagcgttagaattgtcagcgggatgcttttgctgatcatcagcgcgaggatgccagcgagggtgatgacgcttgaaaacagcgatgtcaacgaatttgcaagagcatcgttgagtgtgtccacatcgttggaaaagcggctcatcatttcgccgtgcgtatgtgtgtcataataacggaccgacagatcctgcaaatgatcaaacaggtcgcggcgcaggtcgttgatggaacgctgcgtcgccgtcatcatcaaacgcatttgcagataactggcggcgacggcgacaagatagatacaaagcagcgtgataacgccctgcaaaagccctgcgaaccgctctgaaacggaaagagcacgcaccggctccagaaaattgtcgatgatcggctgcagcatggccgtaccggccaatgtcgcgccgatattgaaaagaaccatcaatcccgcaagaaagagaagcggcttgcggcggcgcagatagctccagacaaacgcgattgaagcgccaaaatttttcggcttttccattgcggattgtttgcgattcggcattacgcgttcgcctccttttcctgctgtgaataatagatttcctgataatcctcgctggcggcgagcagttgctcgtgcgtcccaatcgctgaaatacggccgtcggaaaggattatgatctgatccgcatccttgacggaggaaatgcgctgcgcaatgataaattttgtcgtctggcgcagcgaggtgccgaaggcctcgcggattttagcctcggtggcggtatcgacggcgctggtactgtcatccagaatgaggatcggaggttttttcagcaccgcgcgcgcaatgcaaagccgctgcttttgtccgccggagacattgactccaccctgttcaatccaggtgtcgtatcctttgggaaagctcatgataaagtcatgcgcctgagcggccttggcagcctcgatcatctcgtcgtcggtggcatgttcgttgccccatttaatattgtcgcggattgtacctgaaaacagggtgtttttctggagtactacgccaatttggcttctcagcgattcaaccttatagtcgcgtacatcgcgtccgtcgatcagtacgcggccttcagtgacatcgtacaagcgaggaatcaattgaatcagggagcttttgccggcgcctgtaccgccgatcacagcgatggtctgaccaggctttgcatcaaaatcgatgtctgtcaggatattatttggatgctccggatcatatttgaaggagacatgatcaaatttcacatcgcctttgattgtgtattcctgtgcgtcaggggtatcggttaaatcaatttcagcggacaggacttcaatcgcacgtttatatgaagcggacgcgcgggaaatctggacaaacatcatagagagcatcattaaagacatgaggatttggaaaatgtaattgataaatgcaaccatgtcggctgccgtcagcaaaccgccgatcacttggccgccgccaaaccaaacgaccgctactgtagaaagattcataaccagcatcatgaccggcatactgaaaatgacgacgttcatcgcgcgcagggaggcgtcagtcaggttgtcgttggaaatcttaaattttttcttttcaaaatcctgacgcacaaaggatttgacgacgcgcacgtttgtcagattttcctgcacgctgccgttgagcgcatcgacacgcgcctgcattttattgaacagcggcagcgcatgtgtgataatgaatccaagagaaagcaaaaggacagggataattacgacgagaatgattgcaagctccgcattcatacgaagggccataaccaaggcgaaaacgaacatgagcggcgcgcggatcatcaggcgcagcgtcatgatgcctgcgttttgaagcagtgttacgtcgtttgttaaacgcgtcgcaagtgaggcggtagaaaaggcgtcgatgtttttaaacgaaaattgctggaccttctcaaacagcccgcgccgcagtccggctgcaaagccaacgccagcttttgcggaatggcgcgcattcccaaaacctgccaaaatagcgatcagtgcaaacaggatcataagggagcctgtgccgacaatataagggatgttgcccgactgaataccaaagccgacaatattggacataagcgtcggctggatcacctcgcacacaacgtcgagcagcataaacgccactgcgatgacaaccgactttttataaggcgcaagatacgacattatttgtcgcaaggggattcctcctttttttgtaaatagtcccgaaatacccggagatttgaagccatgcgcgacaataggcagataagctgctcgaattccgccgcgctgaaatccttaaatgagcgttctgtgatttgatcgattaccttttcggcaaaatcggcggattccacaccagcctgtgtcagttcgatccgattggagcgcagatcctgctgatccggcacgcgccgcaccagtccggaacgctccaggcgcttgagagaaatagcaatggtggcaggactgatgtgcagtgcacgcgccagctccttttgattgcatgcgcccatatgtttaagcataaacagcagcgactgttgccctgtatgaatattatgagcacaaagcagacggtttgcgcattgtttatgcagggaaattaagtcccaatgtaaatgaacggcgcgatgtaaatctgctggttgattctgggatgaagcgcgcgggtcttccatgatgacagctccttttaaaacgatacacaatcaaaaagttagacagctaatgattagctgtctaactaatattaatcctttataagaaatttgtcaacgagattatgcaaaagttcacaaatcgtttgcattcggatcgtacaagatgtacaaggcccgagaaggatttccacaaaaccgggtgggaatttatctggatacaactgcggtacactctggcaatttttccaaaagcgtgatacaatatgcacaggacagacggcaaagccgtttaaagccgccgtttggcggttatttcgctgctgcggcattgatagtgataggttcagcagtatttttttgtgcgtctgtatacaaacgatgcaatagatcaaggaggctgcatcatgcattttgaccggccattcttatttgatggcgcatttggcacctattatttttcaaaaacaggtgatgaagccccttgtgagttggctaatttgaccgcaccgcaaacagtcctggatattcatcgtgaatatgcagcatccggctgcgccgcgctgaaaacaaatacctttgcggccaatcctgtttctatccccgattcggtgcgcttaaacgaagtcattgcggctggatggtcgctcgcacagcacgccgcgcaggagaatggcgcgcgtgtattcgccgatatcggcgggatctgcgccgatacggcagaagcggattatcttaccgtcgtccggcattttctggagcttggcgcgcaaaattttttgtttgagactctggcttgctatcaggatgtgcagcgcgcagtcgggctgatccgccaaagtgttccagatgcaacggtgattgtatcctttgctgtttcacaggatggctattcccggcgtggattgtattgccgcgcgctgtttgatcaggcggagtctgacccgcaggttgatgctgttggcctcaattgttcctgcggtcccagtcacatgcgcagcctgcttcgcgcgcttgggcagcgtgcgaagcccgtcgccgccatgccgaatgcaggatatccttcatcgctcaatggacgcgttttttttgaggataacgccggctactttgcacagcagcttgccgctttgtatatggatggcgctgatattcttggcggatgctgcggcacaacgccgcagcatattcgctgcgccgctgctgcgttggcggccgccgcagcccgtcccaaagggacgggccggccgaagctgcaagcggcttcggccgcgggcgctggcgcgcccggcggcggccgcctgggtctgccgcgcaaggagatcgcggttgaacttgatccgccttttgaccacgactgttcatttgtactgacggccgcgtcagagctgcgtgcatgcggcgtcgatctgattacagtgaccgattcgccgttgtcacgcacgcgtgcagacagcctgatgacggctgcgaaaatcagacgtgaggcggggattgaggtgatgccgcacatctcctgccgcgataaaaatcatatcgccctgcgtgcggggctgcttggcgcagcgtttgaagggattggccgcgtgctgattgtcacaggagatccgccgatgcaagccggtacgcgcggttcggacggcgtgtaccatctcagctcgtatgatctgatcgcatggattcacagcatgaacagcgaggtatttgcggacgcgccgtttttaattggcggcgcgcttaatgtgaacgcggcgaattttggcgcggagcttgcacgtgcaaaaaagaagctgtcgcttggcgcgtccatgctgtttacgcagccaattttcagcgacaaagctgttgatcattttctgcgcgcacgtcaggagttaaaggattgccgcctgtttgcggggatattaccggttgcaggctataaaaacgcgctttttttaatcaatgaggtgtccgggatagaaattccagacaatgtcgtgcgttctttggaaggaaaaacgccggatgaagctgccgcgatttcggttgcgtacagtgcgggcattatgcggcgcgtctatgacgcggctgatggcttttatattatgaccccattgaaaaaagtaaacattgtgcggggattgatcgaagaaatcaggaggtatgaacagtgattctcattggcgaaaagctcaacagttcgattccgcgtgcacagcaggcttttgaagctcgcgacacgcagacagtgacagagttgatccggacgcaggccgctgcgggcgcatcttttctggatgtcaacacggcggtttgcgcggccggcgaacaagcggccatgctgtggacaatcggactgatacgtgaaaattgtgattgcggaattatgattgatacagccgatccaaaggtgatggcagcagcggtgcaggcggccggagactgtccgctgattctcaattccgcaacaatcaccgatcggtttgaggcggtgacatcgcttgcgaaggagagcggagctgctgttgtcggtttgccgattgacgacgatatgccgcatagcctggaggagaaatgccaaaagctggactttctgattgagaagctgcgcgccgcaggtattcaggacgaccggatctatgcggatgtgcttgtggagactcttgccacggatggcgggagcgcaaaaagcgcgctcggcgcgattgcatacatggcggaaaactatcccgatgtcaagacgacatgcggcctttcaaatgtatcgtttggtttgccgcgccgtgcgttgatcaacactgcattcgtttcagcggctatggctgcggggctttccagcgcgatcatcgacccggtgtcacccgcaatgcgcgatgcaattgcagcggcacgcgttgtcgctggaatggacgattattgcatggattatatcacttatattcgcgggaatgagtaatttttccaattgttaatacataacgtataaggagtgtgccatatgatcaaattcaatcactttaatttcaacgtgtttgacctgcaaaagagtctcgatttctaccaagaggccttgaacctgactgcggtgcgtgaaaaaaatgcttcggacggttcgttcaagcttgtatatctcggcgatggcgaaagcgattttacgctggagttgacctggctgcgcgatcgtaaggagccatacaatctcggagatctggaatatcatcttgcatttgtgacggacgattacgcggcgcttcatgaaaaacatcagaaaatgggagtggtctgctttgaaaatccgggaatgggcatctatttcatccatgatccggatggctactggatcgaaatcgtccccaaaaaagattgaccggatagaaagcagagaggggcgcgcgctgctaaatgcagtgcgcgcccctctccggcgtcatcgcatattattcagcctgtgcgcgggcctgtccaaatgttaacgggagtgtcagcgcgtcgagctgcggcgcggcaatccagtcgggattgctgcaatcgccgaatttgaccgtatgaacgaccgcatgcgcagtcaggcattgattatgcggcacttccggcgttgtgacaacatacataccaggccgcagcaattggaatacagccctgccgccgcggtattcaacatacacgacctcgccgctttgtaccagtaccagctcctgtaaggcggcatgtgaatggctgctttcccaaacaggctttccggccgcattttcacagcggatatagctgcttttatccggcccaatcaatcggaaacgcagctcaccgttgtccattcgctcgtgatttgtcgaaacgccatactgttcaaatgctgcgccgcacgagattttttccatatggccactcctgtcatgactgaatattgattgcgagcgggcactcaagcacatctacaagcgcgagcgttgacggatcgatcacattgatgtaagccataccgtcgtggctgcccgatgaaagcggctttgacaggtcggcgtccagtatgtactggttgggggcaatgtactgtgaacggtagagaaccgtttcgtcgttgtccgctacgatttcaaggaccatcagatattgattaaaggctggattctgcacacggatgtcgccgccgctgccgtcggacgaaaaggtgggagccgcattgatacggtagccgaacaggccgtcgcccggggcgcgctcgctgtgcggcgcgcctggcagaacgcccgtttgtgcggcaggatcaagcccttcgacacgaaactgtgcggctacctcgccggaggaaccggcgccgtgcaggaagaagaaagcccccgctgcgatcagtacgatgaaaaacgcggtaaacaaaagcacgggcagcatccccgtgcgctttttttgtttgacagccattggatatacctccaaagaagggatcaaataatcttacgcaggattttagggcgaaaccatccccggtaaatatgaagcgcctgtgtaagcagataatcatacataaacagggtgaagtttacaatgactaaaatcactgcgacggtataacgtccaaaatcgccccagccctcgagcatatcgggaaccccaaaaacgaacagcataacatagtaaaacgccacgacgacgatattgaacagcagcagcttaaacagaatggaaagcggccgtgcgagacgttcaatccaaggtttggcaagcgggtagtagccaagcagcaaaatatacatcatgacggcctcacggtccgggatgatcagcagcgcgagcagcgaagtcgccgcgtagacgagcaatgcggttttcagaccgttttcctcgcgtacagaaatcaaaacgatcccggccagcgccgggaagatatacgaggagaaggggatcagtccggtcatgaacatgagcagcagacacaaggcggaggaaaggccgccaagggcgacctgagtgctttttttcatctggcggctgttatgggacgccgccggatcgaaacccggctgccgcgccatcagaaacagccgccgccgcatgcgtcaaggcagcaattggcgcagtacatggccgcgcagatatcacaacaactgcatccgccaacggtggtgctcgatccaaagggactctgattatagcggggctgtccattctgccgctgccagacaagctggttataagctgcgctgtattcgctgttctgcggattgagctggcaggcgcgctggaaacattggagcgcatcgtcaagccagccgcgcgaatagtatatactgcccttgaggaaatgccattcggcgtcgcggtttgctgcggccacgccatcgagcagctcctgcgcctcggccagccggccggcattgatcatacggcggatatcggagaattgagatgcgccggaatatgcccccgcaccagtttgcccgcccgcggagtgcccggctctgcgctgcgcgacgatcgcgtcgtacgcctggttgatctcctgcatcttttcctcggccagatcggacaggggattgtttgcatagttgtccggatgatatttcttggcaagctcgcggtatgcgatttttacctgctcatcggtggcgttcggcgagatcccaagcaccttgtacggatctgtcatctgtgttcattctccttcggcaacaaaattcgttcaacggtttcccgcagcccgagatagatcacattatcaagaatcggcttatatgcgccaagctccagaagctcgtatgttttgatgatttccccaatggtcaaaaaaagcgatcccttcgcgttttcgcgcacatcggccagccgctgcggatcgggcgcgtccagatgttcgcgcagcacaaacgcattgtagctgccgtgacggatatcctcctcaagatcatcgagcgcatcagccagatagacataccgcccaagcagatagccgaatcgttccagtacgcgccgctggccgccgtcatgcgtaagcaggccgcagatttgtgaaagcgcgagcgccgacggttcagccgcgcggtcgacgctgtcgcagcgctcgtcctcaacgaggctctgcttactgatcgtttcatagataatcgaggccacgtccggggtgcggtcggaagcttttttataagccgcgcgcgcgaacggcatgcatagaagcgtcagaaagcgggcgccggttccgccgtccgtataattgtcgagcgccttgtagtaaaacatgatcattgcaacgtcggacgaaaacgacagccatgaacagctttgcaggcagggacgctttttaagcgggttgagaatgcagcgccccggcgcaaacgacgaatccttttcgtcaagcgacatgccgagcagcgtcagaaacgtgaagtcaaaactaagcgtcatgcgcgcgaacgggccatactgccgcccaagctgcttgcacaggccgcagtagacagcctggtacgtttcatattcacagacgcgcagcatccctttactgggccttatatatccaaacatgaatgtagtgtctccaattttatcggattatgaacacaggtgcagtgatgaagaatactcaatgaatgctattattctacacgaactggacagaaatgtgtttaataaagtatgaatttgtgcatatcaatggggttttatgcgctggcagcgggcagaatttatcaaaagatggcggttaagccttgattttatgtgcggttcgcggtatgataggaaaagggtttaatgggtaaatgcgctaaagcggcgcaggaaggaacggaggaaaccaaccgatgatttacaacaggcacgccgagacgatgccgcgcaggcagctggaggcgctccaactggagcgtttgaagcatgtggtgcggtattgctatgacaatgtccggctgtaccacgaccgctttgacgcggccggcatcgatcccgacaagtttaaaacgctctccgacatcaagtacataccgccgaccacaaaggacgatctgcgcgatcactatccgtttggattgtttgcggtgccgcgcaagcagattgtacgcatccatgcatcgtcgggcacaacgggcaagccgacggtcgtgggatacacgaaaaatgatctcgatatgtggtctgaagtgatggcgcgtctgatcgccgcggttggcgtgggcgacgaggatgttgcgcagatttgtttcggatacggcctgtttacaggcgcgcttggcctgcactatggacttgagcgcctcggcgccgccgttgtgccctcgtcgagcggcaacagcgaaaagcagatcatgctgatgaaggatttcggcacgacaacgctgatcgcgacgccgacatacgcgctgtatcttggcgagctggcggctgaaatgggttatacgcctgctgattttaagctgcgcgtcggcctgttcggctcggagggaagcacgccggaaatgcgtgccaagatcgaggaaaagcttggcctgtttgcgaccgacaattacggtatgagcgaactgatcgggccgggtgtatcgggcgaatgcgaatatcgtgatggattgcatatcaatgaggatcacttttttgccgaggttgtcgacccggagacgctcgcggagaaaagcgagggcgaggtcggcgaactggtcatcacaacgatgaccaaggaggcgctgccgctgctgcggtaccgcacgcgtgacctctcgcggatcacctatgcgccgtgcaaatgcggccggacaacggcgcgtatggacaaaatcatgggacgcagcgacgatatgctcaaaatcaaaggcgtcaatgtgttcccgtcgcagattgaaagcgtgctcatgccgatggagcaggtcagtccgcattatatgctttatgtgcgccatgagggctatacggatacgctcgaggtcaaggtcgagctgatcgacgcgtcgctgctcgagcggtattccgatctggagcatttgacagatatgattcattcgcgcctgcgcacggtactcggcatcgacgcaaaggtcacgctcgtccagccaaagacgatcgagcggttttccggcaaggccaagcgcgttgtcgacctgcggtaaaaatacgcacagtttttggcttcgcagcgtcggacgctctgttcgcggcgcaacctgcgtaaacgcagcgcccgccttgctgtttgcggcgcagccgactaaagttttttgccgaggctttttttcaaaaaagccggaaagaggggtaagatgaaacaattgatgttgggcaatcaggcagttgccaggggactttttgaggcgggatgccggtttgtgtcgagctatccgggaacgccgtcgactgaaatttccgaatatgcgagcgagtatgaggaaatttatgcggaatgggcgccgaatgagaaggtcgcgtgcgaggccgcgctcggcgcggccattggcggcgcgcgttccttctgcgcgatgaagcatgtcggtttgaacgtcgcggcggacccgctttttacagccgcctatacgggcgtcaacggcgggatggtcatcggcgtcgccgacgaccctgggatgcattcgtcgcagaatgaacaggattcacgccattatgcaatcgcagccaagctgccgatggtcgagccttccgactcgcaggagtgtatcgattttatcaaggccgcttatgaaatatcggaaacatatgacacgccggtgatcttccgcacgtgtacgcgcatcgcgcattcacagagcatcatcgagacggcggagcgcggggagcggcccctgcgcgattatgtaaaagatcctaaaaaatacgttatgatgccgggaaacgcgatcggccgtcacgtgtttgtcgaggaacgcatgaaaaagctcgcggagctggcggagacgacgccgctcaaccgcgccgagctggccgggcgcggcgtcggttttatcacatcgggcacgtgctatcagtatgtgaaggaggcgttccccgaggcgagcgtgctcaagctcggactggtcaatccgctgccggaaaagctgatccgcgattttgcggcgcaggtggaaacgctctatattgtggaggagcttgatccggtgatcgagacgcactgccgcgccatcggcgtgcgcgtcgacggcggcaaggaccgcctggggctgctcggcgaatattcgcagcgcgagatcgccgccgcgttcggcgctcccgtgccggaatgcgcggacttcggcgagccggttccggtgcgcccgccggtgctctgcccggggtgcccgcaccgcggcctgttttatacgctgcataagctcggcgtcatggtcagcggagatattggatgctatacgctcggcgcgctgcctccgcttggcgcgctcgacacaacggtctgcatgggcgcgtcgatttcggggctgcatggctttaataaggcgcgcggccgcgacagcgccaaaaaatcggttgctgtgatcggcgacagcacgttcatgcattcgggcatcaccgggctgatcaatattacatacaatctcggcaattcgactgtgattgtgctcgacaattcgatcaccggcatgacgggccatcagcagaacccgacgaccgggctgacgctgaaaaaccagccgacgccgcaggtgagcattgaaaagatctgcgaggccgccggcgtccggcgtgtccgcgtcgttgatccgaacgagctgaaagaacttgagcaggtcgtgcgcgaggagcttgaggcggacgaaccgtccgtcatcatcgcgcgcaggccgtgcgtgctgctcaaatatgtcaagcacgcgccgccgtttgtgatcgacgatgaaaaatgcaaaaagtgcaaggcgtgtatgcgcatcggatgcccggcgatcaatattacggacggacgcgtcgtcatcgatgaaacgctgtgtgtcgggtgcgatttgtgcacgaaactgtgcagcttcggcgcaatcaaatcttcggaggtgcatgtgtgatgacgggtgtaaaaagcgttatgattgtcggcgtcggcgggcaaggctcgctgctcgcctccaaactgctcggcaatgttctgatggcgcagggatacgacgtgaaggtttcggaagtacacggcatgagccagcgcggcggctcggttgtaacgtatgtgcgctacggaggccgggtatattcacctattgtcgcgcgcggcgaagcggacgcgatcgtatcgtttgagcggctggaggccgcgcggtggctgccgtatctcaaacagggcggccgcctgattgtcaacgaccagcgcatatccccaatgccggtcatcaccggcgcgatggagtatccggacgatatcatcgaaaagctgcgcggcaagggcgcggacgtcgtcgcctgcgacgcgctgacgctcgccgggcaggcgggcagcgccaaggcggtcaacgtggtgctgatgggcgtgctctccacactgctcgatatcccggaagccgcgtggcaggccgcgcttgaggcgtgtgtgccgccgaagtttttggagctgaacaaaaaagcgttcgcgcttggccgggcgtatcgataaacagaaaatctgacacagaaaggatcgatctccattggcaaattattaccagcccgaaattgagcgcgcctcgcgggaacaaatcaaagcgtggcaggatgagcgcctggtcgatacagtgcggcacgtctatgcaaacgtcccttattacaaaaggctgatggatgaaaagggcgtaacgcccggggatatcaagtcgcgcgacgatctttacaagctgccgtttctgacgaaaaacgatctgcgcgaggcatatccttacggcctgctggccgttcctcttgacgactgcgtgcgcatccagtcgacgagcgggaccaccggaaaacgcgtcgttgcattctatacgcagggcgatatcgatctgtgggaggactgctgcgcccgcgcgattgtggctgccggcggtacgaaaagcgacgttgtgcaggtcgcttacggctacggcctgtttacaggcggcccgggactcaacggcggttcgcacaaggtcggctgcctgacgctgccgatgtcgtccggcaatacgcagcgtcagatccagttcatccaggacctgcattccacgatcctgtgctgcacgccctcctatgcggcgtttatcggcgagacgtttcaggagatgggtatcgcgcccgaagaaatcagcctgaaagccggtatcttcggcgcggaggcgtggagcgaggaaatgcgccgggatatcgagcggaagctcggtatccgcgcgtatgacatttatgggctgacagagatttccgggccgggcgtttcgtttgaatgcgaggcgcagaccgggatgcatattaacgaggatcattttattgccgagatcatcaacccggaaacaggcgaagtgctccccgatggggaaaagggcgagctggtctttacgagcatcacgaagaaggcatttccgctgctgcgctaccgcacgcgcgatatctgcgtactcaaccgcgaaccgtgcccgtgcggacgcacgcatgtcaagatgtccaagccgatgggccgcagcgacgatatgctgatcatccgcggcgtcaacgtgttcccgtcgcagatcgaaacggttctgcttaatcacggctatccggccaattatcagattatagtcgaccgcgtaaagaacagcgatacgctggacgttcaggtggaaatgacgaacgagatgttcgcggataccgtcaagggcgtctcggcacgcgagaaagagcttgtcgacgggctgcgcgccatgcttggcctggcggcgaacgtgcacctcgtttcgcctaaaacaatcgaacgcagtgagggcaaggctaaacgtgttatcgacaaacgtaaattttaatggtatactgaaaaaaaggcccgccgcgccggatatggccgggggtgcacaaaataacagccattgcggcagaacgggtgttgatttatggtcatcaagcagttgtccgtctttgtggagaaccagcccggaaggctcgccgaggtcacagacgtgctgagtaaaaacgatatcgatatccgggcgctttccatcgcggatacaaccaactttggaattctgcgcctgattgtcgatcatccggcgcgtgctgaaagccggctcaaggagcagggctttactgtttcacagacggatgtgatcggcgtcggcattactgatcagcccggcggacttgccgttgcgctgcgcattttggcggacgaggggatcacggtcgaatacatgtacgcattcgtcagcaaagcggaaaagacggcgtttgtgatcctgcgtgtggaaaacaacgcacaggccgaacaggtgctttccgccaagggaatcccgatcctttcaagcgaggatgtcctgctgcgcagccggctctgattgtggtgaatccgtagagtgtgaaaaatgacggccggcggcggattttccgccgccggctttttcgggggagaattggatgtcaattgaaaaggtacgcgcctattttgaggcgcgcggacgcggcggcgacattctggaattttcgcagtcaagcgcgactgtggagctggccgcgcaggcggtcggcgtgattccggcgcgcatcgcaaagacgctgtcgtttcggcagggggaaggatgtatcctgcttgtcgcggccggcgacgcgcgcgtggacaacaaaaagttcaaggcgcgctttggcatgaaggcgtcgatgccttcgcccgacgaggtgcgcgcgctgacgggacacgccgtcggaggcgtttgcccgtttgcggttgaaaacgacgccgtcacagtctatcttgacgaatctttgcgccgcttcgatacggtattcccggcggccggcagcgatcattccgcgattgagcttggctgcgacgagctgtatgaatatgcgaatgccgccggatgggtcgacgtctgcaaactgccggaatgagcttttgcaagccggcgtataaatacaaatcaaaagcgggggaccggaaagtcccccgcttttcccggtttatcgcccggcgccggatcgccgcagcttatgtacagtttcagacacgctttcctgatgaagctccgacgccttaaagcgcacgagtgcaaaattgagattgaacaggctccccagaccaaacgcggaaatcactgtgccgattccgacgcgtccgcccaacagccagccgagcaggatggcaagcagctcgaccgccgcacggcacaggccgaccgaacggccggttttgcgcgccaacgccaccatcagggcgtcccgggggccggaacccagcgcggcacgcatgtagagccaggtgccgatagccagcagttccagaccgcaaagcagcatgaaaatccctgacggcagggaagtcatcagtgggatcaagccaagcgccaaaagacaatcgatcatgatcgcgcataaaacgatattgaggatggtcccaaagccaacgtgttcgttgcaggcgaccgcaaccccgatggcaaccgcgcccacaagcgccgaagctgttccataggtgatccccagggtatgggacaacccctcctgaaggacgctccacggctccagccccacatttgcctgaagcatcatcacgataccgaccgcgctgacaacaagtcccaaaatcagcattccgatccgccggcaatattcacggatcatgttttgcgcctcctttgcggctaagaagctgtaccaattggtacagcttcttaaggataccattcgccccatctgccgcaggcgataaatcccactcgctcataaagccgggccacctcgtcatatccggagatcagccgcggcgttttgccctttttcaggatacgccggacaagaaaacggctgatttgcaggccatacccttgacggcggtattcaggtacgacagcaacagcgccgataacgccgcattcgtcatcctcggagatgatgcagccggttccgatcacttttccatcctgttcaagttggtaaagctccgtcaaccccaatgcacagcggcgtttcaggtcctcagcccacgaatcgaagcgaagatgcgtccggtagtattcatgactgcgttggagcacgtcaaagactgcgtgcagctccccaggggaaagatcgggcgggccgctgtccggtacgccgccctgatagaccatataataggagctgtctgtcgtgccgcccaggattttttgcagtgcctcgcattgcttccaattggtatcgacttcccgcacgccaagggaacgggccaattcggcaatcggttcgggggccgcctgttcgtttgccgaaaccgtgagcacgccgtcgagcagggagagggcggctgtgggacaaccgtcccgttcgcacaaataaaagcgcgccgggctgtcctccaagccgtaagtccgcaggagggtcagcgccctggagccaaacacccgttcataggcgcaggctgtctggaaatcggaaattctggcatctgtcagttcatgcagcataaaaccgtctccaatctgtttattccgcggcgcgctcccgccgtatttgagagaggtagcggtatacgctcgcctgagagcactgaaggatatcagccacggatttgaccgctcctttgagcagaaagatgccgtcgctctccagggtatggataatttgaaggcgctcctccggcgtcagacgcacgggggacagccccagccgcttaagctctctcaaaacagcatcctcagccacgccgccgctggaattgtggaactgctccaccgccggcagggcatacggcgtgtcggaaatgcgcgtttcatccacttggaagttggtgtccacaaactggtccgggtggcacaggtgcaggatgctttcgctcacagcatgataacggctgtcgtcgaaattgatgcacagcatcccgatcagttttccgttatgcttgatgaacagcgtggaggaacgcagcgtccgcccttcggcggacacaccgcggtaatgcgtaatatagtcctgtttttcatagcttttgtccatcagaattttaagggccatattggtcagaggcgcgccgacctccctgccgctcacatgactgtttgcgatggcaacaatggaacggtttttgtctgtcaggtcatgcagagcaacctcataatccggtcccagggtatgtcccagaaattctgtcagccttatataatgcccaagcatcggattcgtcatatcgttacctttcggccagttaatgttctggcatgatcttaaaaatatgcctaaatccattatatcggccgattggaattttgtcaaagctatttagaaattttttattgcaataagaaataatttttgatacaaattttataattgttgttattttatataaatatatataattttacaaaacaatttaaacaaatcgcaaaattaaagtgaaatagcaattgacaacttttatatttgtgataaaattattgcagagctagaaaaaaggaggaatcaatcctatgaaaaaaataatcagtactgaccgtgcgccggcggcgatcggcccatactcccaggcgattacgctgggcggcctgataatcacttccggccagctcccgcttgatccggcgaccggcgccttcccggaggggattcaggcacagacccgccagtccctgaccaatgtcaaggcgatcttggaggaagcgggaagcggcatggacaaggtcgtcaagacgactgtttttctcagcgatatgaataacttcggcgcgatgaatgaggtctatgccaccttcttcagcgaaggcgcttttcctgcccgttcggccgtggaagttgcccgcctgcccaaggatgcactcgtcgagattgaagtcatcgccgaggcctgattgacaggccaaaatttaatttggtaaaggtactgtccgccagtcgtagttgcctgaaacgggaaactggtaaacgatgaccggggtatcctctgaaattgagacgcaaagcgtcaaatatggaggtataagtattatgaaagagtatccgctgaatgttcccgttccacatcatttcacctttgcagtccgcgatgtgcccaatgtaaccgtcgagcagcgcgagcgcgccctgaaggccactcattacaatgagtttgcgttcccgtctggtatgctgaccgtggatatgctgtccgactccggtacaaccgccatgactaaccagcagtgggcatccctgtttttgggtgatgaggcatatggccgcaacaccggctattatgtgctgctggatacattccgcgatatttttgagcgcggcggcgaaaagaactggaaaaagtctatcgacctggtccgcaccgactgccgcgatgtggaaagaatgatggatgagctgtacctgtgcgagtatgaaggcggcctgttcaacggcggagcggcccagatggagcgccccaacacctttatcattcaacagggacgtgcggctgagtccgtgctgatggagattgtgaagaacattctgtccaagcggcatcccggcaaggtctttaccattccctccaacggccatttcgacaccaccgagggcaacatcaagcagatgggttcggtgccccgcaatctgtataacaaggagctgctgtatgaggttcccgagggcggccgttatgagaagaacccgttcaagggcaacatggatattgaaaagttggagcagcttatcaatgctgtcgggcctgagaacgtaccgctgattttcacctgcatcaccaacaaccccatctgcggccagcccgtctccatggctaatatcaaagagatcaaccgtgtcgcgcataaatacgatatcccgctggtgttcgatgttgcgcgctgggctgagaactgctacttcattaagatgaacgaggaaggctacgctgataagtctattgctgaaattgccacggagatgttctcctactgcgacgcgttctccatgtccgccaagaaggacggccacgccaatatgggcggaatgcttgctttccgcgacaagggcctgttctggcagaagttctccgacttcaatgaggacggcacaatcaagaccgatgtgggcgttctcttaaaggtcaagcagatctcctgctacggcaacgattcctatggcggtatgtccggccgcgacatcatggcgctggctgtcggtctgtatgaatcctgtgactttaactatatgcatgagcgcattgcccagtgcaattacctggcggaaggcttttataaggccggcgtcaagggcgttgtgcttccggccggcggacacgcagtgtacatcaacatggacgagttttttgacggcaagcgcggccacgataccttcgcgggcgagggcttctctctggagctgatccgccgctatggtatccgtgtttccgagcttggcgactattccatggaatatgatttgaaaaccccggagcagcaggctgaactggcgaatgtggttcgtttcgcaatcgaccgcagccgtctgactcaggagcacctggattatgtaattgctgctgtcaaggcgctgtatgaggatcgcgagagcatccccaatatgcgcatcacctggggccacaatcttccgatgcgtcatttccatgcgtttttggagccttatcccaatgaataagggttaaagtcatattcagggcttttactacataaacagttaaacgtaactgtgccacggggaagcgcacggcaggaggcgggcgttcgcaattgataaaggcttttggcggacccctgcctccctttttttatctgtgagaggaattttttaacaggcgatacatttgcagagagaggtggatttatatggcagctcctgaaaacaccatggcaaaacgagacggctttaacagcaaatggggatttattctcgcttgtattggttccgctgtaggtatgggaaacatctggagattcccaatcatggtcacaaagtatggcggcctgaccttcctgattccttacttcatctttgtaatcctgattggcgctaccggcgtaatcggtgagtttgcgctcggccgctccgccggcgccggcccgattggcgcctttggcaaatgcacagagcttcgtaccggcaagaaaaatgtcggcgaggccatcggtgtgattccgattatcggttccatggcgctggcgatcggttatacagtggtcatgggctggattttcaagtacacggttatggcattcagcggcgaattgtcagccatgggacaggatatgtctgtgatcggaccgacgttcgatacgatttctgtcgataactttccatggatcattgttgcggttgtagtcagcctgatcatcatggctctgggcgtcgcaaacggtatcgaggtcgccaataaaattatgatgccggtcctgtttttcctgtttttggcgcttggcatctatatctttacactgcccggtgcaagtgaaggctacaagtttattctgacactgaatcccgcagggctggccagtgtggagctgtgggttttcgcatttggtcaagcgttcttctccctgtcggtggctggtaacggcagcgttatctatggctcctacctgcccaaaaatgaagatatcccttcctctgcgcgcaacgtggccatttttgacacattggcggcccttttggcagcgtttgtaatcatcccggccatcgctgccagcggcatggctatgaacgatgtatccgccggacctggcttgatgtttgtgtatctggtcaacattatcaacggtatgcctgccggcaggattatcgcgatcgtattctatgtttgtgtgctctttgcaggcgtcagctcgattatcaacctatatgaagctccggtggcgactcttcaggagaaattcggccttaaaagggcgcctgcgaccgcagttatcctggtgatcggctgtgtggttgccattttaatccaggcgattacatctcagtggatggatgtggtttccatctatatctgtcctctgggcgcattcctggcaggcgttatgttcttctggatcgctggtaaggagtatgtcctgaaagcggtcaacgagggcaggctgaaaccaataggaaactggttctatccgcttgcgaaatacgtttactgcatcttggcgattgtcgctctggttgcaggcattggttttggcggtatcggctgatccggcccggagggttcaaatcctaagctaaaatcggtaaaaatcggcttatctgccgcaaggcggcagataagccccaagggcttgccgctgtggtataataaccgctctgcggatattataccggggttatgcccaacggctcgccgcttgcgcggcaaccgccttttaatgggcgattataccatgccgcttcgcggacatggcataataatcgcgaagcggcatcaaaaccggatttatcggttttggctgagatatagcacaccacctgccatacagaaagcccgcggccgtgttcccacggccgcgggctttcactgcgcttgggcgtttgtattacgctgcgaagtactgaagcacagcgtcggcgacggcgttgccatatttaaacatggcgtattcatctgcgatttcctcatactccgtggggttgcagatatagcctgattcaacaagcaccgccggacaaccggtcatcatcgtaacgcggtaccacgattgttcggtaaaccgcagtttgcggcccgtatcttccgcgaggctccagccaatcttttcagcaagcagctccgactggtcgttgtaataatagacctcaataccggaaacctcattagaatcaaccgtttcggagagagaattgtgatggctcgaaataaatatatcagcatcaaactgctccgccagctcgacgcgttcgttgagcgtcatgttttcattgttgtgcaggacatgtacctttgcgccaagtgccgtcaaacggctttctatggcgtaggagtccgccagatttagaatattttcaaatggcccgttttggccgggaacgccggcggcgccggggtcgtcgccgccgtggcctggatcaagcgcaaccgtgatgccggaaagcggctttgccgaagcgcggtcaagcgtcggccgctgcttgagataaatcacggtgtcgttgttattgaaacgaacatcccagccgagcagccgcacgccttcgtttaaatggaatgtgagcgtcaccgtgttctgctccgtactgctttcaatcgatgaacacagcttgctctcaagcgcggctgtgctcaggttttcaaaaccggtgacattatacagacggattgtaacgctgtcatcgtccattgcgccgtcaaacgcagggcgggcagttccgcggattgtaagtttttcccctttatccgtttgttccagcgaaagcgaggaagcgtttgtttccgctgtctgggagccttccaggatatcgaccgcgcccttgagcacatagccgcccgatgatagatgataatatccgccggcattctccgtgatataatcgacgcagtcctccttgaggatggttgcatattcgccgtcgtcggcagcgttggcattgaccggtacaatgaacgttttcataactgcaacagggcgtgcgccgtttccacaggcgtagacatcgccggcagattgctgctcggaattgacgccgccatattcaagcgtatatgtgaccggcccgatatttttgacctcgccgtcctgtgcgagcgaagaaacgtcgatggttgcctgataggtgacagcgacgccgtccgccgcctgtgcaaccggctcaagcgtcgcggccagcccgccaaccgacgcggtaacggttccgccgcccggcgcggtacacgagagcttgagtgattgtccggggagcacggcttcggcattcgacgggtagacggagcttttcacaatggcgctgatggccgcagatgcagacggctggttgcgtacaatggtagccgtcttgttgacgccgccctgcgtaaaggtataggtgttcgtaccgtatggcacattgaccagcacgccccacagtccggagggagaacgggcgatctcagcgccgttgtagaatactggcaggcttgggtcggacgtgccggtgatgaagtagctttcccaatccgaaccgacagtcagcgtttctgtcggacgcgtcacagcaaattctgtgctgtaggtaagatcgggcatattcgcctgctcagtctgtgcaaacgatgcagccagggaataagcggcggcgcgtgaatcggtgtgcagcgcggaaaagctgctgacaaccaggccgctgccggacgtgcgctcctgatagagaatcgcgtccgccaggtgggtaaaggccgtgtcgtcgctcgcgatatacagcggatagtatgggacgccggaggtctgccagaccgccagcacgctgggtaactcctgttcggttagtccggccaaatccgggacggcaaaatcaagcgcgccgctttccgcaagcgcggccgcgctcggggacgcgcttgacgggagcagcatgcctaggcgttggccctcctttagacgcagggcgctgcgcacctgcgtggccgtttcggaaagcgcggccatatagttgtcaacagcggcaaaaccggccggctccacgccttccagcacgatacccgcgatgtcatagcgggtggcaagctcggcggccacagagccggcaagctgctgaacgcccggctctgtgggattgaatctgccgtctgccgctatccactccggattttttgatgcgggcgaggactcagcaagatcctcggctgacacggcgaacggatcgatcatcgcatagacttggatgccggattccttgcacacattcacaaggtaatcgagcgggtcaaaaaatgcgaacgcaccctgttcccccatccaataggcgctggaaggcaggattgatgagcgatatagcgcgtcacaggatggaacggcttcaaagaacacagcgttgtagccgtattccccggcaaacgcggcgatttcatcgagctgcgcgcgctgctgcttcgcggagagtccgggcgcggatggaaagtcggcgttgccgcgtgtgcggacaatcagcgcgtgcaattgctctccggcggcgggaatgccggcgggcggcgttttggaagaaataggggaggtcaacaggtcgctggcatacaaaacggcgcaggtggccgcgacgatcgccagggacgccagcagggtgcgcaggatggttcgttttgtctcgtgcttcatgaatctgttcctcaattacaatttaaaatcggatggatcaaaaaccggcagcgcattaggccgtttgggcacgcgctttagcggcgcatagcgatatttccggcaagaggcatgcggcgcagtgacgccgcgcttttcgcacagcacggtttcgcccgagcgtgtgataaacccatatttacagtattggcaggccggcggtatctcattggagaaaagctgtgagcggcgcatggcgctccctcccttcaaataacttacaaagtgtggaatcgaccggctggagatcgaatgaaatttttgcttgttcttgtttcgaattctcccggtacaattcagcattgtcttattatacaggattcgacgccttatttccatatacaaatctttaacagtcgggttattctgtcatacggatccttttacgcggtccatccggcagcagaatggcacacatacagatcaggcagagcgccgtaaccagccggttcggcgtatctgggaccgctgctgcacgcgcgctgcccgcagccattacagagagcgtttgcgctggaagaagctgatagaacaaattggccagtaaagcggtgattgcgccgtgcgccagccgcgagcggtaaaacggcccgaaacgcggaaggttttcctgggaaaaacaggcgcgcacctggaacatgatgcttagagaggagaaggaggtgagaaatgcgcagagcgtaaatccggcgcgtccgccaagcgcgcttgcctggatacagccgtttgtgacctccagcgccccggagagcacggcggaaaaaaacggcgcgccgagcgccggaaacagtgcgccaagcgattgagccagcacaccgaccgcgccgaccgcagaaagcaacgctgtgatggctgcaaatgcgacgacaaacgcgcagacagacagcatggaggcgctcgcgctgcgcaccgctgctacaaaggctccgtgttcggagggaaaacggtgatgcggaccggctgccggccggcccgcatgagcgcctgaaaaaacaaacgcgccgacaataaaggcgctgagaagctgtgcggcgagcagcagaagccctgcggtccggctgtgcagaagtccggcgccgactgccgaaataagaaaggacggccccgcgttgacacagcagcagagcgcgcgcgatgcggtatccctgtcggtttcgccgcgcgccagcatgtcggaaagcatacgcgccccaactggaaatccgcccaaaaagctcatcagaagcacggtccccatgttttccggcatgttgagcacgcggcgtgaaaatacagatacagagcgcgaaagcgcgctgcccgcgcctgttgacgtgatcagtcctgcgagaatcataaatgggaacagtgatgggatcaatacgcccgcgcagttttcaagtcccgcccggacgcccgcggcgacctcctgcgttttccacagcaggcatatggcggccgccgcagcggcgcccgccccaagaaaatggcttcgcctcatataccgcaaccccttattacataaaatggccggtccgttaatatgtatgtaacgaacggtgaaaagaatgataccgaattttatatcccgccatgtggcgggatggggaacagggggaaagcctgtgtttggacacagaaaatcgaagccgcggcgcggtacaatcgccgaggttgtgtcgcgttcgctggagatacccgtcgatgtagccggtgggcttgcgcaggtggagctgcttggcaaccgggaagcggcaatcgagcattgccagaatgtattggaatataacgacgatgtgatccgtctgaacacaggcaagctgatcctcaagtttaccgggcgcggtctatcgctcaaatgcatgagcggcgaccgggtcacggtcacgggatttttcacgtccattgagttttcgcagtagagaaaaaacagtatgaagcatttcaggggggcgggagtttgctgtttgtaagactgctgcgctggctgcgcggttatgtttgtttttcggcgcggtccggttctgtggagcggctgatgagcctgtgcgcgcatcatcatattgtcctctggggatgccgccgtacggaaaacgggttcacaggctttacaacggcgcgcggataccggcgcttgcatccatatgcacgtaaggccggtgtgacggctcgcgttggcaggcgatatggcttgccgtttctgctgtaccgataccgccggcgcaccggtatcgcggccggcgtgctgatctgtattttgttcttaatcatttcacagcagtttgtgtgggtggtgcgcattgagggaaatgagcgcatcgattcacaggtgttgtatcaggcgctcgaggaaatgggcgtgcgccgcggtacgcgcaagggtgcgattgacgagcgtgagatcgcgcgtgcgctgccagtcgcagtcgatgggcttgcctgggcggcgctcaacatacagggaacgacggcgacgctgctcgttcatgaacgcaccgacccgccgccgaaaattgatacgaatgtcccggccaatgtcgtggccgcagccgatggccagattgtgcgcatggaggtcacagatggccgcgccgccgccaaaataggcgacgctgtgcatacaggcgatatcattgtcagcggcatcattgaggatcgctggggtatgacgcatcttttgcgcgctaacgcgcgcgtgttcgcgcgcgtgccgcagacgcttgaggcacgcgttccgcttgtgctcgaggagcctgtgccgacgggccgtattgtgaaacgccgttatctggagcttgccggcgtgcgcctgccgctgtttatctacagcgggctggagggcgattacaagctggagcgcgtgacgagccagccaaaagctgggccgatcgatctgccgttttgcgtgacacgcgaaacatacattttttatgaattacagaaggaacagctcgggcagcaagcggctctgcgcctcgcacagcgccagcttgaggcgttggagcgcgagacgtgggatcaggacgctgtgaaaaagcgcgacgtatccgcatcggtggaaaacggcgagcttgtgctgcgcggcgattatattgtggaaatggacatagcgcggcaggtcgagataccggtcacacaatacagccaggaaaaagatgagaaaaaaccagcgcgcgccggcggttactgaccgccggcgctttgccgtctgaggaccaatcaagatggtttcaatagtttaaaaactggagaaatttcacaaaatattcacaaataactggtgaaactgcttgttatttgccaatcaatttgctatactatacgcggggtattgggtgttgttaagagcaggaaacggactaggggctgtttgcgaaaaatttggttatttctctatttttaagcaagccccaggcaaggggacgaatgaaaaaacatgatagagcaactggtaaatatagaccggatggagcatgcgctcgctctgttcggcagctttgacgaaaatgtccggctgatcgaacaggagtatggtgtgactgtcacctgccgcggtacagagatcaaggtctttggcgacgagcagggcgtttcgctcgccgtgcgcacgatcacgggtctgctttcgcttatcaataagggtgaatcgctcagcgatcagaacgtgcgctatgtcatggcgatggtcagcgaagggcgcgaggacaaggtcgcttcactcgccgacgacgttgtgtgcatcacgacaacgggcaagccggtcaaggcaaagacgctcgggcagaaaaaatatatcgagatgatccgctccaatacgatcacaattggcgttggaccggccggaacgggcaagacgtatctggctgtcgcaatggcggtgcgcgctttccgcgcgcatgagatcaaccgcatcatcctgacaaggccggccgtggaggcgggagaaaagctcgggtttttgccgggcgacctgcaaaacaaggtcgacccatatctgcgtccgctgtacgacgcgctgtttgatatgctcggcgcggaaaatttccagaagtatgtcgagcggcagaacatcgaggtcgcgccgctcgcttacatgcgcggacgcacgctcgacgacagctttatcattctcgacgaggcgcagaacacgacgccggagcagatgaaaatgtttctcacacgtcttggcttcaactccaaggcgattatcacaggcgatgtcacgcagattgatctgccggacacaaagcgttcggggcttttggaggccgtcaaggtgcttaaaaacgtcgacgacatcggcatcctgcattttaccgaaaaggatgtcgtgcgccaccggcttgtgcaggcgatcatcaaagcgtatgagcgttattatgaggagggcaaacgcaacagatgacggaacgtgtaaaggtcctgatttccaacaggcaaaaggatgttaaaataccaagcggaatccgtctgctgatccggcgctgctgccatgcggtgctgatcgcggagaatttccatgaaagcgctgaaatcagcgtcagctttgtcaacaatgagcagatccgccagctcaatgccgaatacaggcagaaggatgcgccgacggatgttttgtcgtttccgcttggcgccgatggcaaatatgaccgcaacatggagacgggcgcgcttcagcttggggatattgtgatttcggtggagaaggctgtcgagcaggcgcgtatgtacggccattcacttcagcgtgaaatcggctttttaacggttcactccatgctgcatctgctcggttatgaccatgaggcgggcgggcttgagatggtgcgcatgcgcgagaaagaggaaagcgtgctggcaagcctgggccttgagcgcgacggcagctacgttttgccggaagatgttaaataaaatagccgcgcttgggcgcagcttcggatatgcgctgtgcgggatcgcgcactgcatccggagggaacgcaatttccgtatccatctcgtcgccgcggcgtacgttctggcgctcgcggcgtatctgcgcgtcgttggggtgcgcctcgccttgctgttgctgaccatcggcggcgtgctcgcgctcgaactgatcaacaccgccgccgaggcgcttgtcgaccttatttcgccggagcgccgtccgctcgcgaagattgcgaaggacacggccgccggggcggtgcttgtgttcgcgtcggcggccgtcggcgtggggtttgcgttactctggcagccgcgcgcgcttatgacgctgctgttcgaaacgcttacatcgcccatacgctttctgtcgctggctgtttcggcgctgatcgcggtgtggtttgtattcggattcccacagagggaccgccaaaaggagaacttatgaatttaacacaaccgcaatatgagacaaaatcggcttttgtcgccattgtcggtcggccgaatgtcggcaaatcgagcctgctcaacgccttggtcggcgagaaggtggcaatcgtttcgaacaagccgcagacaacgcgcacgcgcattacgggcgtactgacggatggtgatacgcagcttgtgtttatcgatacgcccggactgcataagccgaggacaaaactgtcggaatatatggtcaggcaggtgggcgacagcgtggccgacgtcgacgtcgccgttcttgtcgtggagcctggcgatgtgattcagaaggccgagcagagcctgatcgattcctttacggcgcagcgtatcccggcggtgcttgtcatcaacaaaatcgatacgctggccgaaaaggagaagctgatggcgcaaatcgccctgttcatgcgggcgtatgcgtttgaggcggttattccggtttcggcgctgcatggcgacggcgtcggcaatgtgctgtccgagctgaggcgttttgcagctttgtcgccgtttttcttcgacgcggacacgctgaccgatcagcccgaacgcgtaattgtggcggaaatcgtgcgcgaaaaactgctgaggagcctgtttgacgaggtgccgcacggcacggccgtgtcggtcgagtcgatgaaggagcgcgcggacaaggatgttatggatatccaggtgcagatttactgcgagcgcgaaagccacaagggtatgatcatcggccgcggcggtgcgatgttaaaaaagatcgcgtcccaggcgcggcaggatatcgagcattttctcggctgccgcgttaacctgcaatgttgggtcaaggtgcgcgaggactggcgcaaccgggaaaatatcatccgctcattcggatacaattgaccgtctgccctgcgccgctgcttttcaaaagcgacgcgctgcaggcgggcaggacttgaaaacgctgtcaagtggtaaaatagtggaaggggagcaaagctttccctacgataagcggcaggatgcggggaacaatacaaccacacaacatttttggaggtggcggtgttgaaacccgacgaggcgatggcgtttaatacatttttacagtccggaaaaatcgaggattacatgcgttatgtcggtgtaaagcggcaggcgcaggcaactgcggcgaaaaacgccgcggccgcgggggaaaacggtgcatatcacaaccgaggcgatcgtcctgcgggcacgatcggttgacgaatttgactgcgtgctgacgctcctgacaaaggagcgcggcgtcatatccgcctacgcacgaggcgctaagaagccgcgaggaacgctgcgcgttccgaccgagcttctcagctactcgtgttttgtgttgttttcaaacaaagaacggtacagcgtcgaccgcgccgatctggaaggcgtgttcatgggcgtgcgcggcgacgtgtgcaagctgtctttggcgtcgtacctgtgtgaattgacggctgaaacggctccgcgcggcgagagcgcaggggagtacctgcgtttgctgctcaattctctttatatgctcgaccgggataaacgcgcctgtgcgtttatcaaaccgctgtacgaactgcggcttttgacgatggctggctatatgcccaaccttgtcgcatgccgcggctgcggctgctttgaatcggagctgatatattttctgccgctgacgggcgagcttgcctgcggggagtgtatcgccgatgcgccgccggaccagccgcggatgcgcctttccgccggcgtgctggccgcgatgcggcatatcctgtatgcgccgtttgaacggctgttcgcctttacgctgccgcaggagcagcttgtatatctgggggaggtcacacagtattatgtccaggtccagctcgacaaacgcttcccaacgctcgatttttacctgacgatcaaggattagggcctgttttgccaaacagaatctttcaggcggcacaggccattacaggggacggaaaatggataaatattgtaaagcaattgaattggataaggtgcttatgcgcctggcgcgccattgttcgtgcgaggacagccgcgcgctggcgcttgcgatcgaaccggcgcgcgacatccgcgatgtgcgcgagctgatgcggcgcacggtcgatgcgaacacattgacgaaccgttactccacgccgtcgatcggcggcgtgacaaattgttccgccgcgctcaaacgcgcggcggtcggggcgcgcctgtcgccgcgcgaactgctcgacgtggcgcgcgtgctgcgtgcaattgagacgatcgaacgctggcgcagccagcttgagggcgatccgacaagcctggaatttttgctcgactgcgttgtggcgctgccgtcattgcagcgcgccatatcgacggcgatcgtaacggaggatgaaattgccgacgcggccagccccgcgcttggagatatccgccgtaaaatccggagcgccggcgcaaaggcgcgcgaggtgctcgaccggctggtgcgttcggcgacctatcagaaatatttgcaggaaaacatcatcacgcagcgcgacggccgctttgttgtgccggtgcggcaggaataccgcaacgagatcaagggattggtgcacgatacgtccggctcgggcgcgacggtattcatcgagccgatgggcgttgtcgaggcaaacaatgaaatccggattctgcaagggcaggaacaggcggagatcgaccgcatcctgcgcgaactttccgcgcaggtcggcgcgtgcgccgacagcatcggcggcagctatgaagcgatcgtcgagcttgatctttattttgcaaaaagccgtctggccgacgagatgcgcgcgaccgaaccggcgatcagcgaaacgggcgctgcggagctgaagcgggcgcgccatccgctgctgcccgcggatcgtgtcgtgccgattgacctgcggctcggcggtgattttgacacgcttgttgtcactgggccgaacaccggaggcaagaccgttgcgattaaaacgctcggtttgctgtcggcgatggcgcagtgcggcctgatgctccccgcggccgacgggagcacggtgcctgtttttgaaaagcttttggtcgatatcggcgatgaacagagcatcgaacagagcctatccaccttttcggcgcatatgacgaatatcatccgaattctggatgaggctgacggccgttcgctcgtgctgctcgacgagcttggcgcgggcaccgatccggtggagggcgcggcgcttgccgtcgccattatcgagcgtctgcgcgcccagggcgcgaaggttgtggccacgacgcattacgccgagatcaaaatgtatgcgctcaatacgcccggcgttgaaaacgcaagctgcgaattcgatgttgcaacgctgcggccgacctaccggcttctgatcggcgtgccggggcgttcgaacgcgtttgccatctgtgagcgcctcggactgccggccggtgtgatcgaagcggcgcgggcgcatgtttccggagaaaacctgcgctttgaggaagtcgtctcgcagcttgagcagacgcgccaggaattggagcgcgcgcgcgtgcaggccgaaagccagcgcgccggcgcgcagcgcgagcgcgacgaggccgacgcgctgcgcagggcgatggagcaggagcgcgagcgtgagatcgaacgcgcgcgcgtgcaggcgcgcgggattgtggagcaggccgggatgcaggcgcaaaagctgcttgacgagcttgacgagctgcgcaggcagaaggacagcgccggctttgcagagcgcgctgcgcaggccaaatctgccttcaaagcgaatatgcgccgtttgcacgacttggccgatccggtgacgcgcaaaaatatcgaacagtacacgcccgagcgcccgctcaaacgcggcgacacggtgcgccttgtatcgcttggacgcgaagggacggtcctgtccgcgcccgatgggcaggggtttgtacaggtgcaggccgggattatcaagacgaaggtgcatcagtcggagctgcgccttgtcgatacaaaggacaggcacgtgacggtcggcggcgccggcgtctcgacgcgcggcgtatcgtcgaaagcctcgcgcgacgtgaaaacggaggtggacctgcgcgggatgacgaccgacgaggcgctgatggagcttgaccgctttatcgatgcgagcgtgctgtcgaatgtgccgaccgtcacaattatccatggcaagggtaccggcgcgctgcgcgccgcagtgcagcagcgtttgaaaaagcatcgcagtgtgaaatcgttccgccttggtacgttcggtgaaggggagtccggcgtcaccgttgcggaattgaaatgatgccgcgctttacaggcagccttgtttatggtatgatatgattaggtgggaaatgattgattttgatagattgcgagtgatgaaggtttggaaaaaaaggtgacgaaggctggcgcgctgacatataagggccgtccgcttgtgcgcagtgggaatacaatctattacggtgacatgggcgacaaatatgttgcgatgctgcagatcctggcggaggcgccgtttgagggcgaacagcttccgagcaaggtttccgtgcagatctggtcgacggacgacgagctgcggccgcgggatcgcgttgtgaaaaagacagagaaatcaaatttgtacgacgcgcttaatatcgcgtcgatctggctggagcgccagctttccggcaagtaaactgaaaaaggcccggtaacgattgactcgttatcgggcttttgtgtaaagactggaggatatagccatgacagaactgcatcttcatctcgacggttccatgcggccgcagaccatcttcgagctggcgtcgcaccagggcatcgcgttgcccgccgcggatgcaaaggctctgcgcgcgtatctcgaggtaccggcggactgcccgtcgctgacggattatttaaagcggttcgatctgccgcttgccgtgctccagacgccggacgcgctggagcgcgccgtattcgaactgtcggaggacctctggcggctcggcgtcgaccgggcggaaatccgttttgcgccgcagttttcaacaagcgatggcatgacgcaggacgacgccgtgtgcgcggctgtcgccggggcgcgccgcgcgatggaaacgtatcccgcttttcgctgcgggttgatcttgtgctgtatgcgcggaagcggcaatatggccgccaatgaggaaacgctgcggctcgtcaggaagcatctgcccggcggggttgtgtgcgccattgatctggccggcgcggaggcgttgtttccgacatccgattacgccggactgtttgaacaggcccgcgcgcagcagatcccgatgacgatccatgccggggaggccgccgggccggaaagtatccggcaggcgctttccttcgggacaaagcgcatcggccatgggataacagccgccggggatccggcgcttgtccgccagcttgcagaagcaggcgtgacgctcgaggtgtgcccgacaagcaatgttcagacaaagggcgccgtcagcctggagcagcatccgattcgcgcgctgtttgacgcaggggtacgcgtaacggtcaactctgacaacatgacggtatccaatatcgatctgccgcgcgagattgcgcttttaaaaacacacctcggttttaccggcgaggagatcgggacgatgcagcgatacgcacgcgaggcgtcgtttttgagagattgaaatcaaagcggcgccatttaataaagcggctcccgcgccagccaaagctggtgtgggagccgcttttatacatgaatctatccgcatatgttcagtcggccgcgccctgctcgatgtgcgggatatcggtcaggccaagcagaaaatcggtggagacattgaaataagcagaaagctttacaaggaaatcgaatgaggcgctgatgccgcctgtttcaagctctttgacattctgtgcagtcaggccgatggcctgcgcaacctcctcaacggttttaccctccgccatacgtaatgcattgagccgttcgccgaaggactttttgttaaacacgggagaagcctccttaatttaagtctgtgtttgataaccggccggtggccgtttgataacagtatatgactgctgcaggctgataagttaaaggaatccgccgtcggccgcaatgacctgcccggtgatgaatccagcgccctcggacgctaaaaacagcgcgagccgcgcgacatcctccggcgttccgagcgtaccaaggggcgtttccagccgcagggcctcgagcgactctggatcaagctgtgcgttcatgtccgtgtcgatcacacccggcgcgatacagttgaccgtgatcccggaagggccaacctctttggcgagcgcctttgtaaagccgatcaccgccgctttggatgcggaataatgaacctcgcatgacgcgccggaaattccccagatcgaggaaacgttgacaattcgtccatactttctgcggatcatttgcggcagaagggcacggcacatataaaacatgcctgtgacgttgacgccaagcatacgtgcccagtcctccgccgtgatatcgcaaagcagtttttgctgtgcgatgccggcgttattaatcaccacgtcgatatgcccaaagcgttccagcgcctgcgccgccgttcggactgcctgcgcttcgtccgacaggtcagcgcgaaagagcgccgcgtcgcagccggcggcggacagctcgtccaggagtgaacgcgcagccgcttcattttgatgataacaggccgcaacgccgtagcctttgcgtgcaaaagccgcagcgcacgccctgccgattccgcgtgatgcgccggtgatcaatacggtccgagacatgtaagccctccatagacaaaagcctccgccataagcggagactgctttcataccgtccgcatccgtctgtgcggcgtgcaaatcacgccgcacagacgatacagacaggcattaatcgttcagatagctcttgaccagcatttgcagcagctcgtcacggtcgattttccgaatcagactgcgcgcattgttgtgcgtagtaatataggtcggatcctccgacagaatatagccgacgatttgattaatgggattataccccttttgacgaagcgcgtcatacacctcggttagaatggccttcatctgctgctctttatcctcatgaatcgagaaggatatggttggctcgtgcatggctttcacctcgtttgggcaagttaaaaatacacagaaacaggctcgttaaaccctgtccttatgttccccattttacaacatatttcgccggatggcaagtgtataaaacctggaggctgtttaaaaaataaaaattcctctttttggattttttaacatataaaatgtatagtacatacaaatcaaagacatacggcaaacccaatcgtttaccggctgcattcagaattgaaaaagctctgaggaagcatctatgctattgtatgggactgccggcgcaaatattctttgggatatttgacaggcgcgtaaagtaaaaagagcggccgcgctttcgcgcggccgcttcggctgcatatatcaataagccttaactgcgcagctctgcaccgatggctctgagcgcctttagcgcgcgcttgacagcggcgtcggactcctcgtcggtaagcgtgcggtcggccgcgcgcatcgtcagcgaataagcgacgctctttttgccatcggcgacctgtgcgccgcggtagacgtcaaacagcgtcaattcctcaagcgtgctgccgacggcagaacggatcgccttctcaagcgcggcgaccggcagcgcgtcgtcgcagatcagcgccaaatcgcgcgccgcggcaggaaaacgcggcagcgggcggtaaccgcgctcgggcgcgacattttcaaacaggacggtttcgtccagataagcaatgtaggcgcgcgtgccaatctgataattttcacagacagccggatggacttcaccgatcataccggcgcatttgccgccgatcagaacttgcgcgcagcggccgggatggaacgcggcgtcctccgcgctggattcatattcgcagccgtccacacccgccgcgcgcagcagtgtttcaacgatacctttgagcgcaaagaaatcgtatgcgtcgccataaagcccgaccgtaatcattgggcgctcgtcaggcagctcgcggccctcctgcggcagatagacggtgccgatctcatagagcgcggcggccttgtttcggttgttgtaattgcgcgcgagcacctcgagcatcgacgggacggttgtggtgcgcatgacgctcgtgtcctcgccgagcgggttttggatggtgacgcaggcgcgcagcgggctgttggccggcaggttgattttatcgtaatatttagggctgatgaaggaataggttgcgacctcgtaaagcccctgggcgagcagcgtctgattgaccagacgctcaaatttctgtttggccgtgtaaccgccgtcggctgtgccgcggatggccgtcacggggattttgtcatagccgtaaaagcgggcgatttcctcggcgatgtcggccttgtgctccaggtcgctgcggaaggagggcggcaggatatcgtcgccgtcaatcttgcattccaggcgcgtgaggatgcggcgcatctccccgacaggaacctcgatacccaaaaactggttgatccactccggttcaagcttgatacggcgcggctcatgacaggcgttgtcggcgtcaatcatgccgccgatcacctcgcccgcgccaagcagctcgacaagctcgcaggcgcgctggacggccgggatagtggtggcggggtcgagctgcttttcaaagcggccggacgcctccgtgcgcataccaagctttttggcggtcgtgcgcacggacgggccgtcgaaacaggccgattcgaacacgatcatatttgtatcgtccatgatgccgctgtattcgccgcccatgacgcccgcgaccgcagagggcttggacgcgtcggcgatgacgagcatttcaggggacagcgtgcgcgtgacgccgtcgagcgtcatgatggtttcacccggcctggcgttgcgcacaacgattttgccgccttccacatacttataatcgaacgcgtgcatcggctggccgtattccagcatgacgtagtttgtaatgtcgacgatattgttgatcggacgcacgccgctggcgcgcaggcgctcgcgcatccagcgaggcgacggttcgattttgatatttttgaccatgcgcgccgtgtagcgcgggcacagcgcgggggctgtgacctcgacggaaagatagctgtggatatcgccggacgcgcctttgacgacgggcgctttgatgttgagcggcttgtcgaacgtgacggccgcttctcgcgccagccccgtgacggacagacaatccggccggttcgaggtgatttcaaactcaacgcacgtgtcgtttaacccgattgccgactggatatcctgcccgggcgccatatcaggctcctgtaaaataaagatgccgtcctcgatcgcatagggaaaatcgtgcgttgtcaaaccaagctcggccagcgagcagagcataccgttcgattcaacgccgcgcagcttgccttttttgatatgcgtgccgtccggcagacaggaatcatgcatggccacggggacataatcgccggcgcgcacattctgagcgccggtgacaatctggacgggcgcgtccgtgccgacgtcgacctggcaggtaaacatatggtcggaatccgggtggcggacgatttgcgttaccttgccgacgacgacgtttttgatctttgcgccctccgtctcatacccttccaccttggagccggacatggtcatcgcttcggcgaattcgtgggcggtaatcccgccgacgtccacatagtcggcgagccatttcattgataaattcatagcgtgcagcctccttgcaatcagaactggtttaggaaacgcagatcgttttcatagaacaggcgcagatcgtcgatgccgtagcggcgcatgacgatgcgctcaaggcccatgccgaacgcgaagccgctgtattcctcgggatcaatgccgcagatggagagcaccttcgggtgcaccatgccgcagccgagcagttcgatccagccctcgcccttgcatagccggcagccttcgccgcggcaggcgaaacactgcacgtccaattcggcggacggctcggtgaacgggaagtggtgcgggcggaaacgcacgacggattcattgccgtaaaggcgcttgacaaacagctccaacgtccccttcaggtcggccatcgtgaccccccgatcgacgacaagcccttccacctggtgaaagagcggcgaatgcgtcgcgtcgaccgcgtcggagcggtagacgcgtcccggcgcaatgacacggatgggcggcttttgcttttccatcgtgcgcacctggacaggcgacgtctgcgtgcgcaggatcacattgtcggaaatataaaatgtgtcctgcgtgtcgcgcgccggatggtttttcgggatattgagcgcctcgaagttatagtaatccgtttcgacctccgggccttccgcaatcgaaaagcccatgccgagaaagatttccttgacctcgtcgagcacctttgtcaagggatgcgccttgccaagcggcgcggcgcgccccggtagcgtcacgtcgagcttttcgtcaatcaggcgttgttcgagctgggcggcgcgcacggcggcggagcgttcgtcgattaaccgttcaatggcggcgcgcacctcgttggcgagctgtccgaccttggggcgttcctcagcggagagtttgcccatctgtttgaggatagcggtcagctcgccctttttgccgaggtagcgcacgcgcaggttgtcgatggcccgcagatcggccgctgagcccagcgcttcggctgcctgcttctgaatggtttgcagcgcgttgatcatttttggttcatccttccgttaaaatggaatgtgtaaacagttttatctttacatctgttcgccggctttcaggtgtgcgacagcaacgggaatatcaaccggtgctttgccggcaggttttctccaaggataaaaagcgttgtatcgtccgcatgatacggccgaatatcatcggcttcaccatccgccggcgtgaatccgagcgccgctgtatatagattgggcggcaggagcgccgaaagagtgtcattgagcggccgtttcgctttgccatatacatcatagcacaacaattcgccgtccattggctctgcgacggccgcaactccgcagtcttcaatgaaaaagacctgccttttcagggattgcgcgcagtaaaacatgagcaaatccctgttatccagcattgggaacgtggaataagggttgccttcggcatacagccgcaggaaaagcgcaaggtcggctctgtcgtccatatcaagcctgcggacctgtgtttcccgccgcgcgattgtacgccgatgcatccattcttctgcggcagaaaagccgaattttgggtaaaagccgcgcgcgttgtcgtttgaaaacaggtaaatggcatcgcattggccgcgccactgttgtagaaccaactccatcaaaaaccggcacagcccgcgttttcggtacgcggggtcggtcatcacagtaccaatctggatataacgccgggcgcgcccttcaaatacggtatccatcagattaacggaaacattggacacagcgttttttccatcgaacaaggtataggggagatagcgcgccccccagtaaccacccgaaaaccatggcgcaaagtcaaggttaaaaatttttcgagccaatgcaaaaaacgccgtgcgtgcagccgaatcgtcccgcacattatgctccaagcggtatatttttccgtttattatacaattattcataatgctcctccaccagatgtcacaaggccattttgccgtgcttttacacaacaaaataaaagccgttcgcccacaaagggacgaacggcagagcgccaatccgtggtaccacccaaattcccacacggggcagcccgcatggacactttcgtgcctgtaacgggacatcccgtcgcggcctacaacgaaatgcttcagccgcgccgctcgcgggcgaacttcgcactttcggccatggtttgctttcagccggcggcaaacctctctgtgatggcgctgcaaagggctacttttcccgttctcagcgttttgattctttatatgataactgtatgacggctattatagcatgccgacatccgttttgcaagcggttttgcgccgctttttaaaggatagcgtcgtcgtctccacagtcatcgcagccatcgtcgccatcgtcaacaatttcaccgacacgcatccggcgggcaatcttcatttcctccacttgtttgtggatcagctctttaacctcgcgtggtttcctgatatttttcagttccagctttggaaggcttttgtcggaggactgcaccaatacggttcccacacggaaaatacgctgccaaagcgaaatagacaggctgatatcgcgcacacggtaaaggataacctcctcctgcttcatattaagaagccctgtctccaaaaacagcctgtcgtccgacagagaatagcgggtaaacgtgatgggcataccgcagatacgtttgcggtcgtgccagagaatcgtgatgccttccataataaaaatcctccattccgccgcgaattgcggcacaaacagaaataaaatgttcccccggcggatgggggattttttcgccgtcattgccggttgccccgaaggggcgaggcaatgggcgcttgaaagacagtgtgaattttcacactgtctttcataataaagtaggcttttaaaaagaatagcatagaaattcatgcttgtaaagccgccgacggcttgatagggacgcgccggacggttataatataaaaaaatggaacagggaggcggctagatggaacagatacagattgaggtttgctgcggctcggttgaggactgcaaaaaggcacagcgcgccggcgcaagcaggatcgaactggtgcaggcgcatacgctcggcggattgacgccgtcagctggggaagtagcaatggccaagcgcgctgttgatattccggttatggcgatcatccggcctcgcatggctggtttttattacagcgaggacgattttgatgcgatgtgctttgacgcccggcatctgctggagcttggagcggatggaattgtgttcgggtttttgttgccggacggttcgcttgactatgagcggtgcgcgcggttcgtcgagcttgcgcgcggcaaacagacggtgtttcatcgcgctatcgatatcacacgcgatccttttaacgctgttgaacgcttggtcagacttggagtgacgcgcattttgacaagcggtttttcagcgggaagctacgacggccgcgcgcagatcggcgcgcttcagaagcaatttggcgatcgcatcgaaatcatggctggcggcgggattaccgagcagaatattgccgccctgattaaagagaccggtgtgcgccatgtacattttggcggtacggcgcgcttcgccgatccgtcctgctcctacaggccgggcattgcgttcggcgcgtctgagttgccgcccgacgactgctatatcgctgtcgacgagtcgcgcgtgcgcgcaatggcgtccgcggcccggaccatggcatagacccgcaaaaaactttccagcttttttaaaaaaagccttagtaaaatacttggccggctgcgccgcgagcagtcggctggacgttttatagaagaaggccgcccgcgtaagcgggcggccttaacctgtccagttttacttcaatgctccttcaccgcccatcagccttgtcatttcctccaccttttccaaaggaaaaggcggaagcacaacaggcttcatggccagcgacataagcttcatgggattatcatccgccgcaatacggtttgaacttaattttccgcaaatgcggcagcgatgaatcaccgcccattctccatgctttctgacccatacagcgattggttccatgacgccgccgcaatcagccatccggtcgcctggttcatcgtccagatgctggctgcataaacaattggggcaatggttccgatgtgaactgccggccccggctgggacgaccgttctcccgcaaaccttacacacaaagctgtcatgacatgcatgtgttttaaaataccctttttcaaatgattttttcttattttctcgtttcattatgaaacatcctccaaaaagtaaaatggtacttttgggaggtttgagcctggattgtcttacgcaaacctcccggttagcagacaatcaccgatgcacagttatttttcatatacgcgctcctaaaaaaatataataacaggtctggccggcgaaccgattggattcgaagccaaacatatttataattattctatcatacattcaaccttttgtctacagaaaactgtttggcgtccagaacgcggtaaatcagttggctaaagcgaaagtgacatcaacgcggccaggcgggctgtcgaatacagaaagatcggaagtgacccttccaatggggaacacgtccacggaaaggatcggatcattggtctgtgcataaaaaatagctatattgtgatgctcctcacaataagtaatttcgccgttttcaaaggttctttgcccgccctccaggctttccgggtaaaagtcaacgccgccataatattcccggccgtcaaattccaccatggaaacggttagaggaaactgttgacgaatctcattggccagagcggtatcgtaaagtaccccctccagcgcaatacccccaacagtgatagaaagatgagtgccttgctgtgtattggaggcatccagggaacttccggccagttccaacccctcaagccagtctgcaatggcgccctgagcatccagaatattttccgcctggatggcaataccggccaatacagcagcctgtggttccgcagctgcgatttcccgatagctgatgcctgcgccgtatccatcgtgagtgcagaaaggaacgaccgttttgccagataggtcataccgagtcaaaaaggattgaatcgcctgtgggacgctggaggcccagacgggatacccaagaaatacggtgtcatactgagagatatccaaattgccgtccgccaaagctggcagaacccccgccgccgattcctcatggttttgctcaaccaccgcatcaaaatcagtgggataaggctccagcgtctggatggaatatagttcgccgccgatctttccctgtatgagataggccacatattcggtggcgccatacagatccccttctttcagaacaagactggctgacgcggcggcgtcgatctcatcgggataattggcgtttcggcccagtgtgaagtaagcaattagagtcttatgaccttctgtattcccatagatttccggagttgaaagggtatccggattactggatattgtctcatctgttgcagtggctgatacggcggcggaattttctatttctgcttttatggagctttgcgcttccggttgtgaaagtggtgtggaacgattgtcagaagaaagcgggttggcttgataatctgcgcaagccgaaaaggacagaatgaataaaaacgccagagccgctgacaaataatttttcataaatattctcctttacaaatcgttgtgtacaaattttgtcttgtgcagatccatatctgacaatttaatcttgtggatgaggtaatccaggttatcaagttgctgctgttcttgatgcagatgctccaaaagcttgtaccgcagctttttcagcagccggagctgctcctgctttttctcctttagggcttccggcgggccgataaacagggccaggctttctgccggtatgcctgcttttctcaaggaacgcaggaaccctaaccgctccaggtccagctggccgcaatccgattgctccgccatgtctgccgggcaggccagcaagccgctgtccagaaaaaagcggagttctgcttcatccaaacggtaatatttcgcatattcttctaaggtcataacccgcctccatataaaaaaccatcaaagaagtggatgcagggaaagaagctctctttccgctgcatccacagtataaagcgttttttttcccatgtcgaatacttagtttttataggcggccaatgcctggaaagcatttgatgtgctcgataaatctggtaactgtcaaactgaagggctgctgctttcgccaggccagcacgctagtggcggtcagttccggagagagggggcggcgggcgatttttttcggatcccaaaaagggatagcgccctctatcacgatggaataggctaaccctttctgcaccatcatagccgcgttagtactgaggttactggtgaaaagcacctgcagctttgtaaagctgtctccaaaccaactggccagctcattctgcacattgaggcggcggggcaggattaccgattgcccaaccagatcgagggcgttgacggcttgtttcgccgccaacggatcgtcaggcttcatcagaaccacccagcgttcccggaccggcatgcggataaaatcatatttttccacatcaataggctccaaaagcaatcccaggtcgataaggcctttatccatctgctcgcggacaaggtcggcggtggcggtaactaggtcatagcggaccagagggtacttttggctgaaggagacaaagagatcgggcagcagctttaccgctgcgatttccccgctcccgatgacaatcttgccgtcgatcagctcctcctgctgagaaagctcctgttcggtcttatccaccaacgcaacaatctcctccgcccggcggcgcaaaaggatcccctcattggtcaaaatgattttccggcctccgcgtttaaacaggcgaacgccaatttcctcctccatctgcgccaactggcggctcagagtgggctgggtgatgtgcagcagctccgcggccctggtgatgctttcttcccgcgccactgcaagaaaatatcgaagaacgcgaacctccatcttactcctcctttttgtattctaaacctttattataattattttataagacgaatcaatgctttttaggcatttgatttgattcgatgtgagtatttgacataatacaaatttgcaggtaggataaaggcggaaaagcaaggcagaaatacgatctgacaaaaggggtcttttatatgtcttatcaaatgtttcttcccacaaaggttttatttggccctggtcgtttgaatgaactgcaggggcagcctatgccggggaaaaaagcgttgctggtgatttcggacggcaaatccgtccgggaaaacggagcattagcacgcacccaggagcagctccggctggcgggtgccgactatgtcctgttcgaccgagttcaggcaaacccgctgaggtccaccgtgatggagggggcgtgcgcggcaaaagagcatagctgcgattttgtggtggctttgggcggcggcagtgtaatggacgccagcaaggcaatcgcggcgatggcggccaacagcggggatctgtgggactatatgggcggcggcaccggaaaggcaaagacgttggaaaatcagccgctgcctctgattgcgatcaccacgacagcaggaaccggctcggaggtggatcgttggggagttgttaccaatgaagaaacaaatgaaaagatggggtttggcggttacgacagcctatttccagtcttgtcggtcgtggatccggagctgatgatgaccgtgccgccccgttttaccgcatatcaagggtttgacgcgctgttccattctaccgagtgctatatttccaaggcgcataatctgatgagcgatatgatcaccctcaccgccattgaaaatattgcaacatacctgcccagagcggttcaagatggggcggatatcgaagcgcgggagcgggtggcctttgccaataccctgtccggtcatgcgatggagctgagcagctgcaccagcgaacattctatggagcatgctatgagcgcatatcatcagtcactccctcacggggcagggctgattatgatttccagggcttattacgaatattttgtggagcggcgcgcctgcgacgaccgttttattcggatggctcgggcgatgggaatttccgccgccggcaagccggaggacttcattacagcccttgtaaagcttcaggaggactgcggtgtggcggatctgaaaatgtccagctatggaatccttcaggatgaactggatggattggcggaaaatgcccgaaaaacgatgagcggattgtttgaggctgatccgtgccctgtgtcccatgaggactgcgtatctatttttagaaaagcatatcgctaaatgcaagcggcaaggaggcaatgacatgaatgggcagatcatcgccgatctctttccaaggggagaggaaaacccttttgggaagttctttactgggacgagctatcttcacatgctcaccgctaccggggtgccgattggaaatgtgacgtttgagccaggctgccgcaacaactggcacatccatagagcggacaggggaggcggtcagatcctactctgtaccggcggccgcggctggtatcaggagtgggggaaacctgctcagggactgcatcccggggatgtggtgcagatcccagcgggtgtcaagcactggcacggcgcggcgaaggacagttggttttcccatctggcggtggaggttccgggcgaaagctgccaaacccaatggtgtgaaccggtatctaatcaacactatggagagctggagcaccccaaacccgtccggtaagaagggagggatcgcttatcaaaccaagctttgtcgttaaaatgacagtggacgcagccatgacagtgctgctcctgctgctgatggcttatcatcttaccggggaaattgcccatgaatggctgggcgccgccatgtttctgctgtttttcctgcacaacctgctgaaccacaaatggtacgcggggctgtttcatggaaaatatcctccttaccgcatcctgcaaaccggcgttaatttgctgcttttgctggcaatgctgggacagatgatcagcggagcgatcctgtcccggtatgtatttgattttctgcccatctcgggccatgcctcttttgggaggacgctgcatttgctgggcgcttactggggtttttgcctgatgagcctgcatcttggacttcactggaatctgatattggggatggcgcgcaaagcggtcaaacgtgccgccaatcagaggagcatccttttcctgcggctggcggccgcactgatcgcgttgtatggcgggatagcttttatccgatatgacctgttatcctatatgctgctggagagccagtttgtcttttttgattacagtcagtcccccactgcttttgcctgtgattatctggccatcatgggactttggatttttgccgctcactatgggggaggattgctgagaaaactgcagcaacgaaagaaaggacaacagcaaaagcgattgtttttaatcttttcttattttcattccgggaatacaaaaaaatggcgcggctgatcaggcaggaaaccgggcggcctgcaacggctggagccggtgcaggcttaacccgccgtttacagcgcagcggtcaggcgcattttaatcaaacagtcccgcgccgaggacggcgcggatggacaattttttatagattgcgctttgcaatctaaaaaataaaggggaaaaaacatgaaaaaaatacttgcattgactttaggtgttttccttctgatgggtcttgccgcctgcgggaacagtccggcggcagacggttccttagccgcttctgcgccctcctccgccagagtctctgaaccagatcgtgcgtccggacagggcggcccggctccggtggaaagcacgcccgaggagacagcctcctccaattccaatggagaggaaccggcttcccccgcttcctctgatgctgctcaagaggaaaggcaatcttctgaaccggacacagaagaacagccgggcgaaacagaaggggcggcagcttctctcgtggcgtatttttcctggtcgggcaatacccgtacagttgcggagaagatccaggcgcaaaccggcgcggatctgtttgaaattgccactgtaaacggctactccaatgattacaacacagttttggatgaagcccaggcggagcagagcgacaacgcccgcccagagctgaaaaaccatatagaaaatatggcggattatcaggtgatctatctgggatatccgaattggtggggagatatgccgatggctctctacagctttttggatgaatatgacctgagtgggaaaacgattgttccctttgtcaccagcggcggcagcggcttttcaggtacgattcaatccatccagagcgcgcaaccagacgccgcagttttagagggtctgtccatcagcggttccagtgcctccagctcggacgcccagattgcagagtggttgagcgggctggggctggcggaaccataggctcctctaagcaaaagagctttttgaaaatggagagccgctttgcaagagatgggatatattggaatataaaggcggagaggagccatgaagaatgaactaccgcgaaaccgatcccgaatttatcgaacgattggaacattttatccgaaacgaagtggtggaggagccgggacagcagttggaggcttgtacccggtatctggcaatccttgccgcccttatgggatgccaggggcttgacacatttcgtctggtgttggccgaagcactggaacaggggctggatcctgtttgggtgaaagaaatggtctatcaggctgtcgattatcttggcatcggccgggtgctgccatttttggacactgccaatgaagtgatgaaagcttgtgatatccaattgccgctgcccggacaggccgctgccacattggacaaccgtctggaaaatggaacggcggtccaggtggagatctttggcgaagggatgcgggatgcctggaaacaggaccatatcaaccgctggctggccgccaactgttttggcgactactatacccggaccggattggatctgcggcagcgggagatgataaccttttgttttctggcggcgcagggagggtgtgaaccgcagttggctgcccatatcaaagggaacatccaggtcggaaacgacaaggattttcttgtgcgggtggtgtcccagtgtctgccctatatcgggtatccgcgcagtctgaatgctattacatgcattaaaactgcgccccatcacgattgattatttataatgctgacagataaagcctccgatgtatcatatacatcggaggcttgtcatattaggacatataagatcagcgcaatatgttgttgtgcgcccacattgctttgtacaattctttcaatggtttatcggataattcataaccggcgcgtttgagcaatgtaaacatgatttcatacccagccagataataatattcccaggaatcctcaatggcgcgtttttttcttgcaaactggctgttgaattccgcgtgctcctctggcgggaactcgttgatatacgaccggcaagtctgttccaacgcctgttccaaatctgccaggccggggatctgtttcaaaccggccggcttcacagcctgcccaagcaggccgccagccgcgccgagaaagccttgtgcaaaataatagttgctgataagttcgtcataatcgataaaagcgtcaacaacgacaggatagctgttgtgcgactcaaattttgggagaaaggaaggatagtacctcataaactcccgatagctggaggagaacagttgttggtagggtatcatggcggtggaaatctcccccatcatgccttctataaattcttctgtaaccatatgcttttgagacattgcgaatcctcctttttgttttatggaaatcggcaaaatcgctatataatcctattaagatttgaaataataaaattttacttctattaagagtaaagctgagcaaaaaaaatactatgatagaatcataatatttgcttggatggattttatatggatttaaattttataataagacgtataaccgaattgcgattaaaaaaagagatttcagaagcgcaaatgagttacgagcttggtcacacaaaaagttacattaatggaatagtatctggaaaggctcgtcctaccgtcgagggattgctagaaatcatagaatatttaggcatctcaccttctgaattttttgaggtcaactcaaacgatcctgatgtagtaaccgcgataactaaacgggcaagggagctatcaagagaagatgccctagtcttattagaagtagcaaaccggatgaacgggaaaagtgatagcaaatagcttttttcattatagcaaaagaaaatcgcatcgtcaatgatgtgattttcttttgctataagactattcttagaatgatattatacgctaaaaagttttattaaagatggttaatcgcggcgtatttattggatacaatgaataagggtgagcaataatgagagcatttgacagattctttcatcttgagccaaaatataaccggtcgtatgaaattattgatatattttatgaccagcttgtctatctttctacccatgttttggatgcttctctaaataagctggtgtcggcagcagtatatcatttaattgaaaccaaaaagattacaatatatcgtgttgaaaatagcaatcattcaaaacgttcttttgcttttaaggaaagcttgattaatggattggagtccttgagcaaagaatacgatcttcctgttggaaagttagtgaatattgcaatttatgtagctttagacgaatactcagaatatttaaatcgtgtaacctattggcgttcggagtaaaaatgattaaatatgataaattatggaaaataatgaaagaaaagggtatttctcaatacgctttatatacaacttacaatattaaccgttcacaacttaatcgcttacgtcataatgaaaatgttcaagttaatacaattgataagttatgcaatattttacattgtcgagtagaggatataatggaacattttgatgatgataataccttttgatcctgttttgaatggatgtgtcaatatggatgtagcttctcgatattcaaacgatgaagctcgctttttaaaaaatattgggttccgcattcagttctttcgtaagaaatgtggaatgagtcaagaagaacttgcggaaaaaagcaatctgagctattcaacgataagtcacattgaattcacttctacctatcccatgtctattatagctctctatcgtattgccgctgctttaaatatcgcgccttatcagcttctaatgtttgattgatgttcatggtactgctgtacacctgaaatggcaacagccgccgttcatattttatgaacggcggctgtttatatgttataaattgcaactcccccttatttgttttatggaaatcggcaaaagggagatttttcgtatgccgtcgattaaatgcaatatataaaaacagccccggaaaaatcggggccgcctttccttgaaaattgacgatgacaggcttataatagaaaaaggtacgggtaccctggacgggcggcccagccttgtgttattataggagcaggtatcgccgcactttagcagggcggggcgatacctgcgtatcacaaaacaaagagcgcctgtggccagccgtatgggaaacgcgatctttccagaaaggttcgcacggtcagcggatataggcaggtctttggtttgcgcaaattggagcgtgataaagatggctgataagcaccctgccaaccagccggaggagacgaccgttctttatcaaaatataaaggctatctgtgacgagcagagaaagagtatttctcaattagaaagagattccggcattcctgcaaaaacgattgctaattggaaggcgaatcgttcttggatgattgcgcttattcgtgttgcagatacactggaaatatccttagataaactatttgatcgccagagtatatcagaaggcgataaccatatatcagagattatgtattcactcaaggatcttcgattgaatgaaaaaagtacagccgctattatcaagatagcaaaaataatcgcattaagtatgactgaacccgaagattagcgtactatttaacgtctataatcatattatagcggtaaaaatactccaagtcaagacaaatatactccgaaaagagtatatttgtcaaattgaggaggtcgtatgaatcagctttatgaaagaatagtgttgttttcgaaatccaatcaaatatctttatatgcaatagaaaagggtacaggaatggctcgtgggtcattacgtaaatgggcaacctctatgccttcaggcgatagaatattgcgtgtcgctaattttttagatgtatctgtcgattacctcttgggaaataccaataatccacaatctcacaaaaatccagaaaatttaagggatgctttaatgcaggtgactgaaatttataaacaggcaaatgctaccgcagacaaaattctcgcatcccaaaatttaatttttttacctaacaacacagatcctgacgaaccgtaaaagccgctgtttgcatttgcaaacagcggctttctataatttgacaaaatatatcattgcctgctaaaataaaatcggcgctgcaacaacggcaggcggttggccacatcacccgaaagggggtgaggctgtgccaattaccataacgttacatatcctcggatacnnnnnnntcacccgaaagggggtgaggctgtgccaattaccataacgttacatatcctcggatatatcgtaacgatacggataaaaggcagaaaccgccactcggccaagtgacggtttctaggtcttgaaaacttagaaattttttcctgggccaaccgcttgtcgcagcgccctttatgtttttattatactgccatgcagccgttttgtcaaaccatcaaattgacaaccgtccacagaaactgtaaaataaaaccggcgctgcaacaacggcaggcggttggccacaccacccgaaagggggtgaggctgtgccaattaccataacgttacatatcctcggatacaccgtaacgatacggataaaaggcagaaaccgccaccccggcaggtgacggtttcaaggctttagtcttgcaattctaacttaaccgggccaaccgcttgtcgcagcgccctttatatttttattatatcccacagccgtacagatgtcaagaaatatgctgttttgtggctgcggtgtgacatatagcgacagcgaacagccttgctgtttgctctgcgcatattataataccatcaaaattgttccggccgtaaccaatagcgcgccggcgatcgctttgggggaaattgtttcatgcagcaggaaaaatgcaagcgcgacagtaataacgagactgaatttatcgatgggaacaacctttgcaacgtcgccaagctgaatggcgcgataataacagagccatgacgcgccggtggctaaaccggacaggatcaaaaataacaggcttctgcgggagatggaggccaaaccgcgctgtgcgccggtggcgaatacaattccccaggaaaagatgagtacaacgaaagtgcgtactgccgtcgcaaggtttgaatcgattttttcaacgcctatttttgccagaacagaggtcagcgcggcaaacacggcggagccaactgcaaatacggcccacatagaaccgcctcctttaaaatggacaggttataaacctatgtaggaaaaccgcctttggctgtccgcgcacgctctttggagtagccgtaaagggcgtttggaaaatgttcgcgcagcgcgctgatcacttcgcgggtttcgcagtgggagagtccgcgtatgctggcagaataatggacgccgctgcggtcgtaaaagtggacggcagcgttcgtgccgatttggacgctcagggcaaccgggttctctgaagccgggatgccattcaatgtgagatagacccatgcggcctcgccatagctgagaaagcacggcatattggaattctgcaaagtgaaataaatgcgccgcgcgccatacaggagcgtaccattttgaagcgaagcggcctcctgttcaatttccatacgatccgaattggcgagcatacgatagcgttccagggtcgcctttcgggaacggcggccgacgaaaaagaaaaggatgccgattgtcagcagaaccccaaatgccaccataaatagaaaaagtgcgacgattgaaaccgtttggatcaggtagccaaatggcataccccaaaaagcgcctgtctcaaagactgaaaaggtcaggaaaaccataaccagacaggccgccgagattgccagaagcagcagcggccggcgcgaccggcgcatcagacgtttgtaaaactggaacgacatgatttattccgcctttccaagcgtccccagactcgcggccttgaggtaagcgttgataaagccgtcgagatctccgtccataacggcgttgatattgccgctttcaaatccggtgcggtgatctttagcgagcgtatacggcatgaaaacataggaacggatctgcgatccccaggcgatctgcatctgttcgcccttgatctcattgatgttggccaggtgctcgcgttccttgatttctacaagctttgccgtgagcattttcatacacatctcgcggttttgaaactggctgcgttcattttgacacgagacgacgatcccggtcgggatatgcgtcaggcgcacggccgatgaggttttgttgatgtgctgcccgccggctccggaggagcggaacacatccatcttgatgtcctcgggattgatttcaacggagtgatcgtcgggcagctccggcagcacctcgaccgaagcgaacgacgtgtgccggcggccggacgcgtcgaacggagagacacgcacaagacggtgcacgccggcctcggaccgcagaaagccgtaagcattgtctccggtaatcaggatcgaggcgcttttaagccctgcctcgtcgccgtcgagatagtccagaattttatacgtaaagccgtggcgctcggcccagcgcgtatacatgcggtagagcatctgcgcccaatcctgcgcctcggtaccgcccgcgcccgcgtggaaggtcataatggcgttgttcgcgtcgtattcaccggttaacagcgtggagagcttctgcgtttcaagatcggactcaaacctttccacgtcggccagcgcctcggaatagacggattcgtcgttttcctcgtccgccagcccgatgagcgtgagcgtatcgtcgtaaagggcgtttagcttgtcgcaggcctccagcttgcctctgacgcgcgccgtttcaagctggtttttctgcgaacgctctacatcgttccagaatccgggagccgtcgtctgctcctccagctcggcgagctttctgcgcagagcatcatatccgatcgcctgcgcaaattcgtcaagctccgcgcgatgcgcttccaggcgcaaacgcagttcctcaaattgcagcatataataggttccatcctttctgaggtgtgtggtgcgtgccggacgggcgcagtccgcaaaccgaaaagcaggcacatattgtcagcatatattatagtattttttcccgtttaagtaaagataatcttaaattcaggatgcggattcatatgctccatactgcgtttaaaagcggcagatcagcgtatttacacgaaaaattcataattatgcccttgaattccgtcaggtttctttgtatgataacacattagaagtaatgcgggaccgcgcgggtcccaaaggatcaggggttgatttcttggcaaattatacaggcgcgcgctgccctgtgtgcaataagcggttcacggacaacgacgacattgtcgtctgtccggtctgcggcgcgccgcaccatcgtgaatgctacagcaggttgggacattgcgccctggcggagctgcatatcgacggacatacctggcagccccccgaacgcgaggagaacgcccaggagccggatgcggctgtctgcccggcatgcggcgcgaaaaatccggcgacgggaatcttctgccagaagtgcggcgcgcccttaagccggcagtctgcgccggattttggcgggcaggctccgtttggacagacgccctttggtgcgcaggcgccgttcggccggccgggcggtccgcaggcgaatccgtatacgtccgcgtttggcggcctggacccggcagaggaaatcgaaggcgtctcagcgcgcgatatcgcgctgtatgtcggcgaaaattcccagtattttttgcccaggtttaagcagatcgccggacgcagcggctttaccatcaatttctgcgcgctgttttttaacttcttttatttcttttaccgcaagatgtacggcatcggcgctattttgctcggccttttggcggcttcacagatcccgacgctgtttgttttgccggaaacaatccggtttgttctttcgcatatggaggatattctcaacggctttaacgtgtttaatctgtttgcgccgacagagcacctgtgggcgtacagtgcgatgtactatatgcgctttgtgctgctggctgcgggggttgtattcgcatgctttgccaaccggctgtacatgcgccacgtgctgaaaaatgtgcgcaaaatccatgcgcgttacgagcagtcgcccggcgggttcaacgacaaccgctacacacaggcactggcgcattacggcaggaccaaccgcgccattgtcgtaattgcagcggttggatgtgtggtcgtatactttggcgtctacatggtcatgatgatggcgatgatgcaataaataaggcccgtcgtctgcgtgcgcgatgacgggcctgtcagtcggagggttactatgaaagttcgcaaggcagtcattcccgccgccggattgggtacgcgtgtgctacccgcatccaaggccgttcccaaggagatgcttccgattgtggacaagcccgctatccaatatatcgtggaggaggctgtcgcaagcgggatcgaggatatcctgattattaccaaccgcggcaaatcgctgattgaggatcatttcgatcatgcgccggaactggaggaaaagcttctttcctccggcaagcaggatttgtacgacgaggtggtcgccttggcgcgtctgtgcaacatccagtatgtccgccagaaggagacgcgcggcctggggcatgcggtctggtgcgcgaagtcctttgtcggcaacgagccgttcgcagtgctgtacggagacgacgttattatttccgacaagcccgcggtcggccaattgatcggcgtgcatgaggagtttgggaagggcgttgtcggtatcaagcaggtagcgcgggagctgctgcccagctactgtacgcttggcgttaacgcggtgcgcggcaatatttacgatgtgttcgacatgattgaaaagccgatgccggaggagattatttccaacttcgccattcttgggcgctgcgtgctgacgccggatatttttgatatcctcgagcacacgccgccttcccgcaacggtgaggtgcagttgaccgacgcgatgcgtaccattgcgcgccatggcggcatgatgggcattgaatatgagggtacccgttatgatatgggcagcaagcttggcatcctgcaggcgattgtcgaagtcggcctgagccatcccgatattgggggcggttttcgctcatatctgcgggagattgcacgaaccctgtgaaccgcgcaaaacagcttggtaaagcgaaaaagggcggcctgctccggcaggccgcccttttcagttttctctcctctcacactgttacgcgaacctcgtcaagatgatcgaccgaaatatccaattcatcgagaaggtactcacaaagctcgttatacagggaatcgtccggaagatcgccttcgacatagcgtgactcggctttgcggatgactgagacaagatgattgatttcgtcgaggtattcattgaagatacggtaataacgctgcttgctgttcatgatgtactgctcctctttgaatcgtcattcaaatggatgacgtatacgtatataatacgctccatttgctagactgtcaatgtaaacttatcgttacgaggtcgtgcaaatggagctgaactattacaggcgcctgcgcgaattgcgggaggatcatgactattcgcaggccgatatcggaaagcggttgggtatgtccaagcaacagtattttctgtatgaaaagggataccgggatataccaacgccagtgctgatcgcgcttgcggatctgtatgggacaagcgtggattacctggtgggacgcacggacaatccatcgcccccacagcgatgaggcgcccttgaaggcttataaccgaatggttattattaaaataattatacgtcttccttgataaactgtcaatagaactgaacagttggattgggaggcgaacaatgacgtcaaattattacagaaggctgtatgatttgcgcatcgaccatgacctgacacagaaagatgtgagcacatatcttggaatgagccagccgcagtattaccgctatgaacgcgggtaccgcgacattccgacgcatgtcctgatcgcgcttgcaaagctttatgacacaagcgtcgactatattcttggcctcacggatgatccacaaccccacagggaacatccgggtatataatccatacgttggggctgatggcaaagccgcctccccaaagcattgtcttggctttttgcggcgctttgtttgtcagcagctacgcatccgtcacgagggacgccgtgttttttcgcggcgtccctcgcgctgtcgggcgattgcagttcggctgtataaatccggcctgcggctgccaacaataaggaaagcgattttgcaggaaagcgaggagttgccgtttgttgggcagacgagctgctgggatttatattgttttggtgctgatttttacaggcatgctttgccgtatgtatgcgctttcaatgggggagacgctttcgtctgcggccaatacgcagagcgcgtttgtactcggcgtggacgacacgcgcgggattatctacgattgcaagctacgtccgcttgttggcgaaaagacgcatctggtagccgcgatacagccgtcgcccgaggcgtttaccgcgctgacggaagcgcgtgaaaaagggcttgacgcgccgttgcccgacgaggggcagaccaagccgtatctgatggagcttgacggccatgaagtttattcacgcggtgttgaaatgtttgaggcggtacagcggtatgcggacgaccaactcgcgccgcatatcatcggttatctcaatccggaaaagacaagcggcgtcgccggcatagaaatggcgtatgacgatttgctgcgccaatacgacggcagcctcaagctgcgctatacgctcgacgcggcgggcaggtcgctttcgctcggcgcgccggagatcgtgcaggacaactataaaagcgaaggcggcgtggcgctcacaattgacgcggatatccagcgcgcggcgcagcgggcgatgaaggacgtcaaaaagggggcggctgttgtgatggacgtcgaaacgggcgacatcaaggcgtctgtctccatgcccgcctatgatgccaacaaccttgcggacagcctgcacaatccggacggaccgtttgtcaaccgggcgttttcgcagtacagcgtcggttccacctttaagcttgtcgtggctgccgccgctttggagagcggctacggccgctatacgccgtatacctgcaagggctatgaagatgtcgacggccatatattttattgccactggcgcaacgggcacggtgaaatcgatttgcagaaggccatcgaggtgtcctgcaacccgtttttcatcgatctcgggctgcgcgtgggcggaaagcgcatcgcgtcgatggcgcgtgaaatcggcttttcgcgtgcggcccagtttacagacgatatcaaaacgcaaagcggaacgctgccggatgacgcggagctgtcgcttgatacggccgtggccaacttttcgtttggccagggttccctgaccgccacgccgatccaggtggcgcagatgatctgcaccgtcgcaaacggcggttatgctgtgacgccgcgtttggtggagggattcaccgacgatggaaagacctattacgagcatacggccgcatacgcgccgagtcaggtgttttccaagcgaacttccgatatcctgcgcgaatgtctcgtttcaaacgttgaggagggcagcggcgtaaaggcaaagccctcgtttggaacggccggcggcaaaacggcctcggcgcagaccggcgtttatgaaacgccgggcgaggaggacagcgagatcgtacacgcatggtttgccggctattttccggctgagacgcccaaatacgcgatcgttgtgctggtggaaggcggcgagtccggttccgacacggccgcgccgatctttaaggagattgcggacgaaatcctgctgcgcgagatgtaacccgcttgtaatcgcgcggcaaaagcggtataataaccggtgataccggttattagttttgacaactccagacgcggggcgcgcttggatgacaacctgtgaggggatacgctgtatgagtgcatatatcattgtgaccgattcaaatgccgatctggtgccgggatttgcggctgaaaaccagattttggagcttgagcttacgtatacgatcgacggcagcacctatcgctgcaacgatcccgcgctttcccggcacgcgttttatgatatgatgcgcgcggggaagatgccgatcacggcgcaggtcaatgtcgaggaggcgcgcgcacagcttgaggagcagctcaaacacggcaacgacctattatgcatcatgttttcctccgcgctttccggtacgtataacagcgtgcgcgtcgccgcacaggagcttgaggcaaagtatccaaagcgccgcgtcgtcgtgatcgattcgctcgctgcgtccgcgggacaggggatgttggtcgcgcgcgccgtcgattacagggagcagggcctgccgcttgaggagaatgcggcgcgtgtgcgtgaggatatcccgcaccaggcgcatctgttcacggtcgacgacctcaatcatctgcgccggggcggacgcgtttccgcggcgacggcgcttgtgggcaccatgctgggcatcaaaccggtgctgcatgtggacgatgagggccggctgatcccaacaggcaaggtgcgcgggcgcaggcagtcgctgcttgcgctcgtcgagggcatggcgcgccagatggatcgcgcacggtgcggccgtttcgccatcagccacggcgactgtattgaggacgcgcagtttgtggctgacgaggtgtgcaaacgctttgggctgcgcgactacagcatcagctatgtcggcccgacgatcggcgcgcattccggcccggggacggtcgcgctgtttttctatgcaaagcagcggtgacgctttaccgcatctgtatgcggatgcggcctggtgaaaaacagttgaaatttgcaattgcgtatggtataatctgtgagtatctgaaataagagcatgaccggtgtgtgcccagacatgcgggtatgcgggtcctgtgcgacagagcgccgtgaaccatgtcaggcggggaaccgagcagcattaagcggtttgtgatgtgcgccgcaggtaatctgcatacccgcatatgtgggcacacacttttagaacctgtatttacagccggggaatgctggacagacgagggattttgcacccggtcaaggcaaattttcgcaggcgggctgccgcccggcaggaaaatttaacgcaaagcgggtgcaaaatccccgtccagacagcgttaaacggctgtgaatacaggttcttattgccgtcagggaggtgaaaacgatgtatcaggcgctttaccgcaagtggcggccgaaaacgttcgacgacgtggtcgggcaggagcatattaccgccacgctgaaaaacgaggtggccgcgggaaagttttcgcatgcatacctgtttaccggttcacgcgggaccggcaagacgacctgttcgaaaattgttgcaaaggcggtcaactgcgagcggcccgtcgacggcaatccgtgcaacgaatgcgccgcctgccgcggcattgacgacggttcggtgctcgacgtggtggagatcgacgccgcgagcaacaacggcgtcgacaacatccgccagctccgtgaggaggcgtattttctcccttctgtcgtcaaataccgcgtatatattctcgacgaatgccacatgctttcacagggcgcggtcaatgccctgctgaaaattctggaggaaccgccggagcacgtcgtgtttatcctggctaccacggaaatccacaaggtgctgccgaccatcctttcgcgctgccagcggttcgatttccaccgtatccgttcgcgcgccatcgcggataggctcctttatatcgcgggacaggagtcgttttcccttgcggacgacgcggcgcttctgatcgcgcgcctgtcggacgggggtatgcgcgacgcgctttcgctgctcgatctgtgcgcttcgtttggaacagacatcaccgtgcaggcggtgacgcaggcagccggcctggccggacagtcgcatctgtttgaaatcgccgatgcggcgatcgcgcgcgacccggcggcggcgctgacggtcgtcgggcacctgagcgaacagtcgtgcgatttttcgcgtctgtgcgaacagatgatcggccattaccgcaatttgatgattgtcaaaacggttcgtgaggcggacgatcttgtgcagggcacgccggaagatttggagcgtctgcgcacgcaggccggcggtatttcgctcggtgcgatcatgtatgcgctcggcgttttgcaggacgccgcgacgggcctgacgcgcacggcgtttaaacgcacggagctggagatggcgattgtccgcctgtgcgacgagcgcatgggcagcggcttggagggcgtgctggaccgtctggagaagctggaaaaagcggcgcgtcttggcgccgtgcaggtgccggctgcgccggcggcgcagccggaagcgtccggggcggcagatatgcagcccgcggccccgactggtgcgaagcaggtatccgccgcggccgcttcaaagccgaaatcggcggccggcgcggcgcaggtgacgccgttcggcgattgggcgcgcgtattggaggagcttgcaaagatcaatgcggctttgcgcggcgcgatgaacgattcacgggcgtttgtgcatggcgaaatgatgctgatcgactgccaaaatgagctgttccgcacgcttttgcgcaccagcatcgccgcgaaggagagcctgcgcgacgcgattttggcagtcacagggcataaatataaccttggaccgtataaccccgacaagtacgcgcctgccgccgcgccgtcagacccgctggaagggatgctaaaaaaggcgagcgagctggacgtgcctgtcgaactgaaataaaaaggcccgtgaaacgggtccgcttatgttggaggaatgaatcagatgaaagcaagattgccgcagggaatgggcgggggaccgcagaatatgaacgcaatgatccgccaggcgcagaagatgcaggaggacatgaaggcaaagcaggaggagcttgagcagctcacgttcaagacgacgtccggcggcggcatggtcgaggtgacgatcagcggcaaaaaggaggtccagtcgatcgtcctcaagcctgaaatcgtcgatccggaggacgtcgaaatgctccaggatttgattgtcgcggctgtcaatgaggcgatccgcacggtcgaggagacaacaaacgccgagatggagaagatcaccggaagccttcagattcccggtatgatgtaacgtgtgatggcgtatcatgtagtaccgcttgtaaagctgatcgaacagtttgagagactgccgggcattgggcgcaaatcggcgcagcgtctcgcgttttatgtgcttaatctgccgcgggacaaggcgcagcagtttgccgacgcgattgtcgaggcgcatgacaaaatcaaaaagtgcagcatttgtcaaagcctgaccgaaacggaagtttgtccaatctgttcggatcagtcacgcgacgcttccacaatctgcgttgtggaaaattcgcaggatgtgctcgcatttgagcgcacgcgggagtataaggggctgtaccatgtgctgcacggcctgatttcgccgatggacggtatcgggccggaacagcttcatatcaaggagctgcttgcgcgtatttcggccggcggcgtcggcgaggtcatcatggcgacaaatccgaccgttgaaggcgaggcgaccgcgatgtatattgcgcgcctgctcaagccgatgggcgtgcgcgtgacgcgtctggcttatggaatcccagtcggcggcaacttggagtacgccgatgaagtgacgctgttccgcgcgcttgaggggcgaagcgagctttgattacatagggttcgtacctgtgccgctcatgcgggcggtttttcacagaaaggatggggcgttttatcaaacgccggacaatagatgtttcaatttggtgattccggacgtgaggagcttaagcgcgcgctcaaattcgcagtaaccggcgtcggcaacaccgtagtcgactttgttgtttttaccgtgttggctgtgtggctcggcgtcaatgttccgttttcacaattctgcggatattctgcggggatgctcaacagttatctgatcaaccgaagctggacctttcaaacaaaggatcgctttttcagtctgcaaatggcgcgttttgtagcggccaatgtggcggttatgcttttaagcatggttctgattcaggcggggatcgcttatcttggaatgagcaaactcgtggcgaagctgtttacaacagcgtttacaatcgtggttaattttttaatcagccggttgtgggtattccgaaagtagattctatggaaagggggaaacgtctgtggaaaaggtatctaccaaaacgatttcggtcaataaaaaagcgcgtcatgactactttgtggaggaaagctttgaagctgggatcgagttgtttggaacggaagtgaagtcgctgcgcaaaaatgcatgcaacctcaaggacagttggtgcgatatcgctggtggggagctttttatcaagcagatgcatatttccccatatgaacagggcaatatttttaacagggacccatatcgtccgcggcggcttttgatgcatcgccgtgaaatcaataagctcatgggtctgattgcacagcagggatatacattgatcccgttatccctttattttaaagggtcgcgtgtcaaggtacagcttggattgtgcaaaggtaaaaagctttatgacaagcgcgacgacatggcgcgccgcgcggcacagcgcgatattgaccgtgcattgcgggatagacaaaaggcgtaaagacgtgtataatacgaatgggagcaactgctcccttgctatggggatgtaaaggtttcgacggggatctcgaagtccaggcagcgggtagaggagcatgcacctctataaaagtatgacgtttttaaattagacgacaacgataatttagcttttgcggcttaattaagccgccgttccgctgcggagtaccacggccgcggacggagcgtcgatgagtggtgaacgatcggtccaagcgcctcgtaggacatgattgtattgggggctaccaaactgcatagcctgtcggacggcgatgcggcgcgggaagtttaaaagaccgactgcacccggagaagcttgggtggactggttttcggacaggggttcgattcccctcatctccaccaaaaagaatgcccactttggataccatcggcagaaatgccgatggtatcggcctttttaggggttgtttcacctcgaatttcacaggtaaaacaaaagatccaaacggggggccacagaagctggctggattcgaccccccaaattctttagaaatttacagcgccctttttgaaatgggatttttcaaaaagggcgctattttcatatccagcaaaaatcagagcgccaaagacgtcaatctctcagccaacaggctgaaggattggcgccttttttcatttcccgaaaaagggcgctaaagttacaagggaggtaaagagatggaaaacaccaatgtccggcatgaggaaatccgcagccgcttcttcggtgaactgtccctgcagctgcgggaaaagggcatcatatcagagaggaagggcgcaaacatcctgcgtgtgtatctggatggggaacccgtctgcgacgtccactctaccagcaacgtcttcagctgtgaaggccgcaaagaatccgaggaggctaacgagctccaatatgaaacagcggggatcgcgcacacggtcagagcgtacctcaatgagctggaagccgcgccccctctccccgccaagggtcttgaccccgaggatggttacaagcagctggccaactttggcggcgttgtgctggcaggcagggaaaccgcgcatggctgccagtttgtcacatggagctgggaccccaggcatgaatatgtggagacaggccgctacttcgccggaaactatgagggcgccaaacaggatttcgccatccgcgctggattggtggatcgcaatctccttttcatcccagagcagatgacagaaatctaccactgtgtctcggaggagttggagaatagctgttatgccggagacaaacgccagcggctgctggaggatatccgccgccagatcgagtacggcgtcccaaatttagaggaactgatgagccaaaccaatcaaaacgaaatcaacatgagtatgtaagcgccggggttttagagaaaagcccccggcgcttttttgcgtttggaggaggtgatcgacatgaatacagagcaaaacaatcccgcgtcccataccggtaagactgtcgggcggaccgcccataagtgcgagggctgcccgtatccccatcacggctttatttgctggggcagggatggaagctgcatgcgcaccgatgtggaggagctgaccgagcggcactggcggtcaaagatgagccggtaaaattggtgggtttgggtattccctttgactcgcggttacggtattgtgtgtcgttaagaaatggaggtggaaacaatgattttcaacgcggttctcaaaaatccaaagcatgaagaatatggcaaagcagccgtccccttcccaatcccacccaatgattatgagcatattttggagcggctggaggcgttggagctggcatcgagtcttgctcctaggggatgaggaatatctggataggatatgtgactacatgggcgttgagagttttgctgaaacgaccatacaggaggtgaaattccatattccctacgctgcggagctgatccccacagaatctgcttgtgtggaggacaccaacgaactggccttttgcctctaggagatgcgggagcgtggagatggcgaactgctcaaatacccccttccccgtcctgtcggttctgctgccggaaaccatgcgtgaggccctgcgcctcgtgcttgatctggacgattacgagcgcgtcccggatgacatggaggaatacgggaaagcggtactgcgcaggtttggtgctgacggcgagatcatcgacgccatcgacggctacatggacttcgccgcgatgggtggaggcgtatattgcagaggacgggatacggagaacaagattcgggatggtcagacggatcagcgcgcctttccccgaagtaaccagcgaaatacagatgggggactataaagatgcagatcacaaaagaatggctggcgttcctgcgggagcagtttcccattggcagccgcattcggctcagagagatgaaagacccataccacccggcagagccggggacactgggcacattgcaggccattgacgatgtgggaaccttccactgccggtgggacaatgggcgtacactagggctggtgattggggaggacagctttaccgtcctgcccccgaagcccaccctgctcaagctgtatatgcccatgaccgcagacctttatgaacaaaatcaatggggatattgggaggattaccccacggaactggacgcttccgaggcggtaaaatatgcggacagcattctggcggctatccaaagagaacggcgtcaagaggaagcggaatgtgggatgatgtgctaccatgacgaggacgatggggtcaaccggaaggtccagtcctacacctttacggcggaggtccgggagcgaaagctatggggggtggctgaatgtgaagtactgggaacactggaatcgggcgaacgggagaagctgaaggaaaccatcagcggacaagccagcgacggctttggcgagggctttgagcagcgggcaattcaggcgccggacggtgagatctatgcccacctgtggagttcggacggcgactggagcatccggactgagcaggaactgttcggtcccaggctggaccgttatgaggaacagaagggaggaattacccttgggtaaaaaaatcttcgaggcagagatcagcaatgatgggccaatggaaagagctgccgggatgcggacgcctccccatacagccgccgaagcaatcaaccatcttggcgcagcaaatgaattcacaagaaagaccggatttatagcgtggctgcaccacctcagaatggagggaggcagattgaataaggcgtaatcatttgaactggtaaccaaaaataataacagaataacagccaggggccgttttcccgaaagggggacgcggcccctgcttttcttttctatgccctttttcgggaggacgccccggaaaaggagcggcaatgaatgaagaaaagctggcacagtacctgaagctgtgctgcaagggcagagcaaataccaagcggagcgatgagatcgaacgggcggttgggctcagcggcaatgagctgagaaagctggtgaaccggatgcggcgcagaggcgtccccatcgggagcagccgcagagggtacttctatgcggtcaccgctggggaggtatacagcaccatccggcagctgcgggaggcgacaaaacggctggaggacgcggtcattgaaaacaaggacgcggtgaagctgattctggacagggaccgcccggacgggctgatttactgcgacccgccctactatgacgcggagcaatattacgacgccgtgttttccacagaggaccatctccggctgcacgatgcgcttaaggaatgcaatggctatgtcatcgtctcctacaacaactgtgaggagatccgcaagctttacagcgacttttaccatctgtccttcgcccgtcagaaccctatggcccagcaggccggagtggtctatgaggaactgctcatgaccaactacgacctcaggccctttgcggggtaggcgaccttgttcgacaacccgctggaatttggcgggatgcgcctgacccatatccccgaaaagccattgaagattatttaaaggagtgtttgcaatgaaatttctgagacaagcggccgacaagggacttcgaatcctgcccgctgaactggcaatggccggtttccccgaaactgaaacagcagaggtgcatgtgggagaggacgccattgtggtgctcaagcgccggatgactgggatggagctgatccgcgccgcgaggcagctccatgagctgtcggtgaaactgaacgtccatcttgccaaagcctgcggtttttgccacgactgcgcggatatatgcccatttgaagatatagaggaagaaattgaccttcccagttatctgcgggagaaggccgctatcgatgagggcgccaagctgtgcgtctatgtgaatgaggaggataacagcgtcgccatcgcccaagcgaaccaccaatatgacctgcgggacgtgccgcctgagatgctggatatgttcctcggtaccggcctctgtctgggggaactggatgagctgctcatcaagggggatgtcgtttatgaaggataacttcccatatctctacccctactccctgcacgacgccaaacagcgggacgaactgggcctttggcgggaaagccatcgggagaatatcgcctgtaaaaaggccatcgaggacgctatccgcaaaaacttcgatgggatgcatcttaaagaaggctgcgtaagcagcgtcgttgagcagtacggctttaagcgtgtcgcctgggtgctgtccaacacccttcagcagaaggattgggacgggcggttttccccttccaacaaaaagtgggcggtccaaacctacatccccaaggatgcagaccataccgtagattacattgtagaatcgcaccccgctgttttggatgggtttgtatccgaataccggaaagcggtgctggcgctggagctgttcggggaggaacactgtgtgccggattcctgcgccaagctggattacgagggtaaggtgctggtactttccccggataccctgcgtgaaagctgctggagccaggaaaaccaactctggctggcgctggacgggttcggctgttcccccactgcaagaggccgctcgatacgctgcgtctgcctcggggacggagaggaaaccagatggaacagggcggagtttaccggcgtcttaaaggaagaacatctgcccgactgggcaagagagaaactgaagcggctgcaatctcatgagacacagccgccccagctttccatgtgaagggaggatttttataaatgagaaagatcaggacgcctttgctggcctgcctgctggttttgtccatgagcgtcaccgtgtttgcagagcagccgcagacagtcatcggcgcggacgagaatgggaccggcatcaccatcaccgacatcacccccagagaggacgaggagaatgagcagaaagcagagcggaaaacaaactacaaggtgggaaacttctatcctatcgaaatccagaccgcagaggaggatggaatccgcctgctggtcaagaccttccttgtgccgcaggatacagaccccgcggcgctcgtcgaggaggggctgatccgccggggggtgaaataccaggtatcggacatcctgcgccgggagcttgccggggaatccgaaagcaaaacagtaacagaaaccatcaccatgcccgctgatacggatgaccgggaaaaactgctggcgctgttcaccggctccatcccctacagctaggatgggtttgcggggacgctgaccctggaaccggagtccatcaaagccaaggcggcggataccgaggggtattcgtataccctcaaggatacaaaggagttttccgggctggaccgaaatgatccctattacatccccaaaacttcgcagaaaaacggcgttaccctacaactggcggacgtccagtgggagcctatggccagcgccgctgggaacagcgaagtcccgtctctcttttccgccaccgccacctataccggcacggcttggggcagcaaggccagcggatatctcgccactgcctcctacagcggcgaggtgaccaaaaccgaatccggcgatcagatgatcagtatcgtgtatgaggaggctgccacagaaccggcggcgactatcgattggagttccgtcctgctgccggttttgggagttgtacttggcgcagggctgctggcgggcggctggtttggcggcaagcggctgctggaaaaacgcaggcagaaaaaaaccagccagacagcggacagcggcccctatacgggccgcccgccaatggatacgccggatctccttgcagagatggaccggggcttggaggaggaaagatgatgaataagcttaaagatctttggaacagcagcggcagacggttcctgctggtcctgccggtggcggcggtcatcatcaccgccgcggtgtggcaggcaaaccggatgctcacaccccccgcgcggactatcgcccagccccctgtggagcaggaggtgacctttgacatggaggtcaaccgggcctacacctcggaggacgggattgtggtgatccagccctccggcaagcaggaacagacaccctcccaggacgcgcagaagcttttagagcaggcttccgctgctaaccccgaacaagtgtggacagaaaacatccccctttcgacggaggattacactctgccggaggaggccgccttgcaggacggctctatcgggacgctgtccatcccgaaaatctccctcaccgccccggtgtatgagacggaggacggcggcgaaatagaggggatgaccaaaggggtggcccacttcgccatcacctccgcttgggacgggaacattggactctgttcccacaatgtggcgccggacggcgcagcggcatatttccgggatctccatctgctgcaaaagggcgaccggatcacctacaaaacagccctcggggatcggcagtacgcggtcagcgaaatccgggagatcccgcaggacaactgggactgcctcatgcgcactgaggataaccgccttaccctcatcacctgcatcaccggcaagcccgatttccgccttatggtgcaggcggtcgaagcttaaccgctctttcctgttgggtttggtgatagctttcctttgcctttgctggtatcctttgtggcaaaaggaggtaatatcaaatgaaaaaaatgtttcaagcaatgcttatcgccgccatgctgctggcctgcaccgtcaccgcccatgccgcgccctctgagctggaggagcagtacggccacatccgcccggacggcacccggatgccgcagacctaccggtgcgcagagatcatcaaccgcagggcgtccaccccgcagatcgcggcggagtcctggctggactcaccggcgtatcgggagatcatcctggatgagcggtaccacagcgcgggcgccgcctgctggaagggcgcggatggcgtcgcctactggtgcatgctcttttacaaataagattagccatatcattgccgggcccccgaaagggggccttattttgtgcctgtaaatattttcacagaaaggaaatcactatgcgaaagaaaacaaagcagattctctgcacggctctttcggttgtcatgctgctgggcatcatcccgatgcaggcgttggcggcgccggctgttgacgccggggggatgatcaccccccagcaggtttcggacagcgcggcggaaactcccccccgatccagggatgaccgtggagcctgagacagaaccaacgcccggcccctccgctgatccggatgctgctcctcccgctgaggaaccgccggtaaaggtcacagactccggcacacagccgccggaagcggagggaaatccagaagaagaccccccgccgggccggccattggagagccggacgaagaaaagccttcagaggagccaaaggacgatggccccattcactggctccaacagtaccagcaagcggcgctggaagcgtcccgaaaccccatgccgcagtcacgttccaacaaagcctcagccggttccccctcctactccatgattgaatggagcggcggcaatctggagtttgccaatggcgcctttttaggcagccccatgccgaagatctatatggatggagggatcgcgttctgcgccgagtggaacggacagcccccctccggcgattatgtccagtcaggcgagggcagcgaccccgccatcaagcagatcctcgccaattacgacaactccggcaagagcaacgccgattacgcagcggcgcaggcggccatctgggcccacatcatggggacgtcggtcagctcctggggcggatgcccgggaagctcctccgcggacaagatcttaaacggcagccatgataccagcagcctcaagtacaactatacctcctggacgggcggcacccaggatctcattacctataacacagaggaagaaccagatccgaagccggatatcgatccggatgactacccagaggacgagtatcgcatcgaagtggaaacagatacccagaccgaaacagaagtccgaaaccgcaagagctatgaatacagcgacgccattgggcagatcaccatccgcaagcatgaccaggatgaaaaaagcctggacggggcgctgtttgacatcgacgtggccttttcggacggcacccacaccactgtggaaaattgggaggtggataatggagcgaggctgttcacctggacacatcccaaggacaaccacgatccggcaacggtgacggtgaccgaggtgcgtccgccccacagctatgaaatggaccccaccccgcagacggcggtggtggcccccacctacacccgcatcacccatgtggaaacctggacggtcaccatcgtcaccgaaaccaccagctccaccgtcatcgagatcgcctccggcgaggtggcggcggaatcgaaatcctcctccagcgccgaaaccgagagcgacccccaggtggaggaatttaccgactttattgagggcgacagagagacaaccatgacctttgtcaatacggccacgccctgttcactgacggtctataaatatgaaacaggaaaaaagtcagtggcgctggaggagttttattggcgggatatgctccccgacgaggcgcggctgggcaagatcgtcaccggcacctggtcagaacggctcacctactcgatagagtacaaaaccaaccgaaaaaaccgctggcgcacgttaaaagatgggctttccagcaaggttagctacaccctggactgcggcagagaaaacttgaaactggcggcggatgagtatgttgccgagttccgtttcaattttgggacagtgcagccgggcttttgcgaggaaacaggccccgtcatctttgtcactgccctcgccaatctcaaggatggctatcgcattgtcaaccgcaccgacgcgggcggcaggaccggcgaggaatgggtgattggaaaggacaactggattacatggtctggaacaaagaccgggggaatctgcccaagaccggcgtctgagatgcaagagggcagcggcggtttaaccgtcgctgccccgcgatttatgatgattaatccagtttaaaatcccctcatagccgagagagccgtccgccacagaaaacccgagccggatcagctcctgttggctgtagcggatctgcacctggtttaagcgcagagtcatcagcatcaccaacatggcggtgcgcttgttcccatccaaaaacgggtgattttgcgcgatggaaaaggcaaggcgggcggcgcgctgttccggcgtaggataggcttcctcatcgccaaagccctgcagcgccccatacagagcggactccaacaatccaagatcccgcgtcccggcaaggccgcctgtgacgttcagcagtttttcatggagcagcaagacttcctccaatgtcaggttgatcatttcgcaagctcctcaaatgcctcaaggttttccgagatgagcgtatccgcggttttgccgatgagagagcggcggtactcctgaaagctgtcatattccgaaaaatccaccacggcatagcgtggtttattgttcttcaaaattacagccgcgccctgctcgtcaaccagccgtgcgaccttggaaaaattctggttcgcctcggtcatagcgaccaaagcgttggtattgatcatcatggttatcaccccaagaatagtatactcaaaatataggataaatacaacctattaaaccattttattttaagcagaggaggagtggatatgccaaccattcaaaacatcctccacatccagggcggcggcgcgaaagccgccgcccttttggatttcatcgcggaccggcggtatggccgggggtccatcgactttaacaggatcacccccatgccgccctgggtttaccgccagcccaccaatcaagagctgctcaggcagtatggcgagcaaaactgctcccgcggctggtgtcagcaaaactgggggacggctcagaacgctctgcgcccagagcgatgggccaaacggtacgacggcggagaaagcatccgcttcgacaccgaggacagtgatgtgcgggaactggtccgaaagctctcgctggtatttaaagacctgtatctcgactacctttgggcgagcgaggatgtggggagcaatgtaggggctgtccagtacaaagatggggcggccctcattgagttcatcccaaccccggcaaccagggcggcgattgagaaatcgctggacatccttggggcgagggccgcagactacggactcgtctataacccggccacaaacaactatgaatataaaggaggaaatcgccatcaaagagaaattgatcttccagggcagcgtccccatcggttattttgaggggaggtcggcggttctggacagcgatttcatgggctgcagcaccggcaaggagctgatccttgccggcgtcgccatccgctggctggatgggattgcggacgccctcaaaaatgagctggagggacagaggaagaaaggcggcagggtctgcgtttaccagctcatgtccggcgtcccgccggagcgaaagtttctcccctaccggcagctggaggagcggtacggcggcgcggaccggttggattaccatctcatcttcgatggaatggttgaatacgacagcctggacagcctctatgagctgttcagcgtcaaaacgccgcccaaaggctacatcggacggccgctgtccatgtcggatgtgattgaaatttataccagggataattccgtcctctactatctggatgcggaggatatggttgagattcagtggagggaacaccgataaagaaatggagggaatgaagatgaaaaagaagattgttacactgctttgtgccgcggggttaatggtatcccaggctgtccccgcgctggctgctcccagcggggatgtgtccggcgtgattgagcagacctggaccagcgccgctgcccagatcaagacagtagtcaacagcgtggtgttcccggcgctggatatgatcctggcagtgctgctgtttgtaaagctggcgtcggcttatatggactaccgcaaacacgggcagatggagtgggcgccggtggcgatcctgtttgcagggctcattttttccctgaccgcgccccaatatatttggcagataattggtttatagcaaaaatccccatgcgggtataatctaaatacccgcatggggattcaatatttaggatgtcttttgcttttagtgtgcgaataagaatatttgtttatttgcattctttaccaataatgcgaagctagatcaacccggtaaacgagaagtcatataaactaaaaaaattcaaaatcaatccttcggattgatttctaaatactcagcataaggggttaagtctatagcctgacttgataagcgaaccatttcgtcttctccaataaaatctactatttctgcaaagccttgtactcttttgttcttgtataaatatcgattttgcatcaattcatcaaaacggacccagataaaactcattatttccttatgagcgtctttcgacaagtttgcattttttattatttctttagcgcggctattttgcgagtaaatgctttccacaacattttttgccatttctttcttaatatttaataagtataaatgaatgtcataattacgtattagttttatatcatccatacttcccgcgcttaaatgtgtggtagaaaacgaatcaatgtattgatattgaaaagctgatatgatttctcccgataatctctcgtgtatcacaaactcagcaatgcgcttattacttttttctatattaccaagtttctccaaacccttagatggaatttgaaacttttgagcaaaataatcccatctcattaacatataaggttttttcattattgttccaaacactaaaatatcacatacatttctatggcttaatacttttgacaacttataggacaataatgctgataatgacgcatgcttttcaaataaggtcttttgataatcaagtaattgttctccactattaagtaaaagcatattggtttgccaattactatgcccattagattcaaaaattgatttatctgtaagacaccactctaatagcactttgttcaatgtaacagtatcatctgattgtggaatagatatatttttattgtcaataaaacccaaaacatcaagcagtgaaaatagcacttgagatgtttcttctgagtattttcctagtttagttggtaaatatctaccattactgccatctagataatctataatcgtttttaagggtaaataggaaaaaatataccttctaacaagaaaaagcaaatcaaatgttgatcccaaacattcatttgacaaagtactgatttgggataatgatacccattttactttttgaattgaatcttctaaaacaaagttttctatttttgtaattgcttcatatacaaatagatgtagcgtaattggcgttttattgtcgtcgcccaaagattttgaatttatatttgtaacgtactttatctcattttgataaagagtgaggcccagttcttctttgatttcgcgcataactgcatctaacgaagtttcatccttttctaatttaccgcctggcaattgccataggcttgcaccaacgcgcgatttttgacttctctgtgtcaaaagaaccttatttctataaattattgctaaagcgcaagcttctttttttgtgtcaaaaaataattctttgtcctttaaaatgtaatcttttgcaatgaattttggtctatcagttcgttttggatagtctacaataagcattgataattggtcaaatatcatattttcaaattctgtttgatctgaaaatatatagtagtagaccccatcgcgaccgacttttttctttaattcatctatctcgtttgactgacagttagcactatctaaacaattactatttttaaaatacagcatgattatagtgctaggattaaatgcatgtttttctaaggcacgctcatattcttcaaccgtcccagatatgcttcgcgaagtaggcgaacctatactattccaaaacataccgataaatatttcataatcatcatcaacttgcttattaataacatcttgagcatcttcaccgatatcggaataaatactattttcccaagtgataagttgcagtcgtgtttctagtttcataccaatagtttgattgatacgtttcactactttatggacaattagtcgttcatcttcgaggttagaaggtgaagccaggaatacttttagtacttttcgccccatttttgcaacctccatatacttttctcttttagaactaaactcgacagttaaccgtatggcacattattttctccccaaattaaaattgctttaagaaaagcggttttttttattttactataaaatcaagttttaatcaatcaaaaacaaaaaggaatattactatgcagaaaagattactgatcttctcagtacgttcaccacccttatacgaatattgtctggggcatctgcccggtgcgggaaatcccttaattgacgcgataaacagggcggaagaaatcgatacctgtacagtgggctatggtccgtttggaatcggcgtgggcgatgatttccctatggggattgagatgtacctgcatgtcgagccgaatctttatttcggtacctatacccctgatccggaaaaaccggagacgttcaccgcccgttttgtcgcctatacctttgatagcaccggcatatgctacgggcatttcctcaccccagaggaaaccgaccggcggcatatccttaccgcagaggaactcgaccagctcgcctgcttgacagacgacgcccacgaacgggaaattatccaagcggtcaaagaattgacctcgttccaaatagaaatgagtgaagaagaatacaaacaggcagaggacgccgtctatgaccggactgtgaaagagtccgaggaggttgacgaatccctgcaaaatggtgaaaagcccgaggatgctcctgagatggaggaaacagaggaggttgggccatccctcaccaatctgagcctttgaaagaaggccggaaaaccgtaagaaggcgatgtttttttgttcatatgggattttgcggcggacacggtgctgggacagatcttcgactgggtttacgccagaatcgtggaatttctcggagagttcttcaccatgatgaacggcatggggaccgagctgttcgagctggtctgggtgcaggcaggtggcggggctatgcctcaccgcttttttacagtccaccatcctgattgccgggctaatggtctttaaccaaaacatgctgctgggctgcggcctaatgctctcagccactgaaatcccccggatcgcccaacaattcgggttggataccaccacaagagcaaatatcatgtcggcggtctacgccacccagacggtggtcaacctcacccgaaatctggtgacagccgccgccaaatagtgaaaggaggccatgatttgaaactgatttacatcgcgtccccctttgcgggggatgtggagcagaacattgaaaacgcccggggttactgcctcgaggcgatggaacggggagtcacgccagtggctccccatttgatttacccgcagtttttaagtgacagcgatcccgcccagcggaacatggggatgcgggcagggttggagctgctctcccgctgcgacgagctgtgggtgtgcgggccggagatctcagccgggatgcacaaggagatccagttcgtaaaagggcttggcatccccatccggcagatggagccggtccagcaggcgggaccggccttgtcgctgtgacgctgggcagcctctttgacgggattgggggatttcctctggcggcggtccacagcggcgtcacccctttgtgggccagtgaaatcgaagccttccccattgaagtaaccaggctgcggttccctcagatgctccaattgggggatatcacccaattggacggagcgaagctgccgcctgtggatatcatctgcggcggcagcccttgtcaagatttgtctgtcgccgggcagcgccgggggctggctggcgaacgctccggcctgttcatggagcaggtgcggatcgtgaaggagatgagagatgaagatatccgacgcggccggacagctcagtttgttcggccgcgattcttattgtgggagaacgtgccgggagccttctccagcggggcgcccaagggagaggacttccgcatggtcctcgaggagatcatccacgttaaagacggttcctgttcagtgcctcgacctgactccggggcatggggacctgctggggcagccatattgggaaaccaattcagcctggcttggcgatgtatggacgctcaattctggggcctcgcccagagaagaaaaagaatcttccttgtcgcggattttggaggactcaccgcgccccaaatactatttatccccgagagcctgccggggtattttgcgcagagcgcgggaacggggcaaggagctgccggagaagctggaacaggcgttaatgctgcaatcgggcctcatcccgccccatgattgggataggttcagagaaacgattgcttttgccgccaaccagagggatgaagtgagggaactgtacgatgtggcaggagctttgggatcgcagcccggtataaagcggcagacctttatctctggtttttccgcgggcgcgggttcctccgctgggagcgttggctatagtgaagaactcactcctacgctcaaagggagcgccagcggaaactgtatgccctctgttctctgcctcaatgaccaggacggcgctgaaatagggattgggatatgcccggccattactgccgccgctggcatgagtgaaaacaatcagcctatgttgtttgaaaaacacggtgtggattccagatatactgggcctcacaatgtttcccccaccatatccgcaagagccggtacaggggggaataacctgccgctgatggaacaggagcccatctattgcatcatcggaaacgccatcggccgccagccgcaaaatggtgggaatggcatcgggtatcaggaggatatctcatataccctgacaagttgtgatcaccatgcggtctacagccgccagcgggcggacatgttcaagaatagcgatgtttccagcacccaaagcgcaaggcagtacaaggacgccaccggccttgccatcgaaccggcatcggaacaatttgctgtgtgcctcatccgacgcctgaccccactggaatgcgaaaggcttcaaagcttcccggacggttggacggcgatccccggcgcgtccgactccgccaggtacaaggcgctgggcaattcggtagccattccatgtgtggaatacgtcatgcggggtgtggctctggcgctgcgggcagctggatagggcttgttggttatgcgctgattccggcctctatcttcggtgcatatggtgaatagctttgccagcccctatggggtatactttcgttgcgaaagcagaaaggaggaaatcaagtggagaacagccgcaacctatgcgcacaaattcccatactgctgcacgaaagggtgcgaaaagaacaggaggccctgaacctgactctcagtcaatatgtggaacgagtcctgagcgaatactatgagcggaaagaaggaaagagcagcatgaacaacaataccagaacccttgcattccagatcccggaggaactgtttaaccggattcaaaactatctggccgcccagcggcagcagaccggcaagaagatcaccctgaagtccttcgccatcggcctcattgagcaggcagtggaagaatgggaagaaaacagcggctccccggttggcggagaggacgctgaataaggaaggggttccctgtgaaactgggacggcggaggaaatatccgccgtccttttttctatcacagcctggccggcagtattggcaagaaggacacactgttcctgttccgtctggatgaccccttggaagctatgagcggcaaatggatcgaagaaaacggttcagatatagtgcatgacgagaagaaccggcaccgtatctattagaacaatactgtatggggtcgcagctttgacttattatgaccaaagaatctgtatagcatttggaggtgaccagccatctatatctaccccgacaatctgaaagccgcccccaccctggggctgtggcggctgcgggatctggcggcgggcgggctgctgggggtgctgggggtgctgggcgtggtgctgttcgcctacgccggctccctcctctttgccgccgtcgccgccctgtatctttttctaaccatccgctttgacgacgtctgcattttggattttctccgcaaagccgccgtctatttcatcctgcggccccagtcctaccgctggggccggaatacattggaggtgacacatcatcaaaagaaacgatctgttcagaaaagggaaaagcaagcgaagtgataaaaatacccgcaggctcatgaacatccgaaagatcaccgatcacagcctcgtcaccctgtatggggacgaggttgttttctttctcatccagcccaccaatgtgtcggtgctgtccagggagaacctgaaagcgcgggtcaacgcccttatgcatgtcctcaagggcttcgcggaggtggaactgctctgcctcggctcccgcgagagctttgaacacaacaagcggtatctggccgggcggatcgagcgggaggagtcccccgccatccggcgtctgctggaacaggatatgcgccatctggacgagatccagagccacgccgccaccgcaagggaatttgtcctcatcgtccggccaagaaacatcggggaacgggagatcttcccctaccttgggcggctggaacggctcatccgagagcagcggttttcggtgcggcgggcgggatacgacgacctcaagcgtatcctcgcggtctacttcgcccaggatgtcatcagcgagggctatgatgatttcgacggccagcggtggctcttgaaaaacggccaaagcgactacaaggccgccagcgtcatggacgacgatcgggttctccagagcttccttgacctcatcgcccccagcgccgttaagttcgaggtggaccggtatctggtgggtgggagctggcggtgcgtctgggcggtacggggataccccgcttccaccgaggagcaggccatcctccagcggctgggggaacgggcgggcgtcaccctgcggatctacacacggctggtcacccccggcgaggaacgcaaaatcctgcaggcggcggataaggccaaccggtacaagagcggcagcgccgacatccggcaggcagtggaggcccaaagcaatctggaggacgtctcctccatgatccgctccacccagcgcaatcgggaaccgtttttccataccgctgtttacatcgaactcatcgcccgcaacgaacaagaatttgccgagctgcgggacagtgtggaaacagaactgggccgggcgaaaatcagcgtggacaggctgttcctctgccagcaggagggatttctttcggtgatgccctccggctggaatgtgtttggggaacagttcgagcgaatgctccccgcctccagcgtggccaatctgttccctttttcctacaccggcaagaccgaccccagcggattttatatcggctatgacaaatatggcagttccatcatcaccgacctggaccgccgcgcccaggacaagagcaacgccaattttctcatcctcggcaactccggccagggcaaaagccacctgctcaagctgctgctcatcaatatcctcgaaagcggcaagcgggtattgtgcctcgatcctgagggggagtaccgggaaatcaccgaggcgctgggcggcagctacctcgatctgaccgagggcagataccgtatcaatgtgctggagccgcggatgtggtcggcagaggaaaaggaacccgaccccgaagctcccgccgccttccaaagcggctcggtgctttcccagcacatcgccttcctgcgggacttcttccgcagctacaagcccttcaccgaggcggagatcgataccatcgagatcatgctggggcggctctatgagagccgcgggctgcgggacgatacggattattccaggctgccgccgcgggattatcccatcctgtccgacctctatgaccagatggacgcggaataccagcgtgtccgcgccggcagcggcggggagctatacacgccggagctgctgcgctccgcctgtttggggctgcattccatgtgtaagggagcggactccaagttctttaacggtcacaccaacatccgggacacccgcctcatcaccttcggagtcaaggatctaatggagggcggcaaaaacatcaaggacgccatgctcttcaatgtgctttcctacatcaatcacgcgctcatcgcgggcgggaacacggcgggcgtctttgaggagctgcacgtgttcctctcaaacccggtggcagtgtcctatatacgcagcgccatgaagcgggtgcgcaagcgggacagcctgattggattggcgtcgcagaatatcgaggatttcctgctgcccggtgtggctgagatgaccaagcccctgttctctatccccgtccaccactttttgttccatcccggcgccatcgacaagcgggggtacatggacgctttgcagctggaggagacagagtatcagctcatcctcgcctgtcaaaccggctcctgcctctaccggtgcggcgccgagcggtacaacctggtggtcaagacgccggaacacaagctgaaactgtacggcaagggaggaggaagataggaaatggccgcgcttgtacggatggttccccgagaggactgggaagttttgaaaaaatatctgacagataccgaagggtgcgtgctgctctcggaatcggtgctggaaggactgccaaaagaacagcgggaacagctccagacggttgacaattgtttggttgagtacgactacggcggggacgcagacatctgggttgacatggttcagtcccccgacgcctactttttgaaagacttttttggaaacaatgaacccgattatgaggtggactgcgatgaggaatgttatggatgcggtcggtcttgcgcggaccggatagaacccagcctgtaaggacgaaatcatgaaacacaggtggatgtaatgtgattaatcaagcggaggaaaaatgaacattgtaggatatggcggcgggatcaattccaccgccatgatcatcgggctgtatcggaggggtatccccatcgacctgatcctgttttcggacaccggcggagagcagccccacacctatgagtatctgcctattatggatcagtggctccgggaacatggcatgccgcccattacaattctggaatacaccgaccgcaatggcgagcggctgaccttggaacaggaatgcctgcgctccggggcgctgcccgccctcgtctacggcaacaaatcctgttccctcaagcacaaggtggggacacagcagaagttctgtaataaccacccggaatgccgaaaggtgtgggagcgcggcgggcggatcgtcaagttcatcgggtatgacgccggggaggagcatcgccgtacccatgccattgtctatgatatccaagataagaaatacaaaaacgaataccccctcatcgactgggggtggttccgggaggactgcattcaagcgattcagcaggagggcctgcccctgccgggcaagtcctcctgtttcttttgccccagcatgaagcgcagcgagattcgcaccctctaccacaaccatcgggatctgtatgaacgggccgtcgccatcgagcgaaacgcaaagccaaacctcgtctcggtcaaggggctggggcgcagttggtcctgggaggattttgtacaggcggacaagaaccagacagcattttgcgggctgtttccggaaaacgatatgccctgcggctgttatgacggggagtgacggaggtggtgcagcttggcaaatcccgcgctcatcaaggccgccgtcatgttggctgccgacaagcggacctggaaagtaatcgccgtccttttggcggcgatcctcacccccttcatcctgattgtggtcgtgatctgttccctgctcagtgggacagcgcatcacaacaatgcggcggtggagctgaccttttacggcggcgatcttctcatcaccatgccgggggaatacagggactatatcaccgagatgcgcgcctgcttttcctctctggacagcgccatcgcggacgtcgaagcagagatggaggatggagatagccttgacggaatccgcgtcaaggctgttttctatgccctctatttcggttccgatcacctgcggctgcgttctgccgccgccagagagtttgtggactgctttgtttattatgagaaatgcgtccatccggcagaggaggaagatgaggaggactatgtccatctgcgggccttccccatcgacggcctgcccgccatctatcagaatgtgggcggctacgcaggccggacggtcacgccggatgatatggcgaacatcaccgagatctacctgcgggtggtttaccggaactttgatgtgggcgcggatatgccgctggagggtggaaatggcacccatgatctcatcggagagatgacaaaagattcagaggtagtgccctccgaaggaggattcctcagcccactggatggcggttggcgggataaggtgacctccgagttcggttatcgccaaaaccccaccggcgccggcagcgagggacacaccgggctggacatgggagttccccttggcacgcctgtgcgggcggtgaaggatggccgggtgctgttcgtccgctacaagcagaccgggtatgggtaccatctggcaattgaccacggcggcgggctggtcacgctctacgcccactgttctgaaattctggtaacagaaggacaggaggtgaaagccggagacgtcatcgccaaaagcggcagcaccggcagaagcaccgggcctcacctgcatctggaggtgatccagggtggcgtgccgcagaacccgagaaactatctatgacaaggaggaaatattttgaatcaacagattgtggagcgtgcggtggaaaacatcgtacagaaaggaatgcttgaaactgaaaacggcggctggtatctggaccgcgccgcatttcaggaattgactgggatcgacctgggcgcggcgcaagggcgggaaatgttttttgacgcgctggacaaacgcccggaggtcatttcctgcttttatgcctgtgacttcagcgggattgggatcgagtttgatcccgcctgctgtccaaatctggaggaaacggctggcatggaaatccgcctgtaaaaattaagaggaggtaaacggttgtgaacaagacggaactgaccctctccatcgaggaggaaaagctggaggccatgaccttttggctgaaaaaggagaacgccaccgtccagaaaaagatggacgaggcgctccgggagctgtatgagcaaactgtcccggaggcagtgcgggagtatctggaccgcaaagccgtcccagccagagagcgttctaggcggccggccagaaacaccagcgtaccggcgataccggcggggacggagaaaaggtcacaggaatgaggtgatggctgctgaggactcaacgatttggaatcgaaattgagatggccgccctcgaccgtgtggtaaaggaaaacggcctctcctacaccgaatgctgctttgaacggctcgatggaaaaacggtgaaaaaggagcaggccctacagaactgaacggacaatccctctcgtgtcccgcctgtgccaccctgtgtgccgctgtcgggcagtaggcagtaaccccggccgcggcgacgccctgccggggctttgtgcccagggtttggaacgcggcaattggacagggtttcccgcccaatcggggtgaaccaaggggtcgaaaaaagggcaggataaagcggcggcgtcaccgcccctcacaccgtcccgcaacgcgggccgggaatccgcatgaacagcggctttgcggggatagacagttcccgctttttatggcatgacaaaaatcgatttggcattaaaagtgacatggccctgccggaaaactgcatggctgcatagtttttggaggtttcaatgtgacataaaggaggaaaatcgatatggaagaaaaaatccgctttcaaatgcggatctcaccggaaacagatcaaaaggtcaaagcggcgatcccgcttgcaaactgccagagccagaatgagtttgtggagcaggctctgctccattactgcggctgcctgcaggcggcagaggccgcctccatcctcgcgccggaactcgccgccgccctgcgcatgacggtgcgggacagcgagacgcacacctgccgactgctcttcaagctggcggtggaggtggacatgatgatgcatgtgctggcctcggggatggagatcgacccggcggtgctggataagctgcgcgtcagatgcgtccaggaggtaaagtctaccaacggcggcgtctccttcaaggatgcggtcaactaccagaacggtctgtaacagatgccccgcctcatcttcaagtgcccgtacatcaagggcagcgcgcaaaacgcggcgcggcgggagaactatatccggtacatctccaccagggaaggcgtcgagccggttcgcccggagaatgcggacaaccccgcaacgtcaaaacagaaggcgctgctctcgaacctgctgcgggatttcccggacagccgagggatgttcgagtacgaggactaccgtgcggcgcccaccaggggccatgcctcggagctgatctcccggatcgttgaagaacatctgcaccagatgtctggcggggaaaagtatctggactacatcgccaaccgcccccgcgccgagaagctgggggcgcacggcctgtttaccgcgggcgcagatccgccggcgttgtcccaggcggcggaggaggtgtccaaccacaccggcaacctctggctgcccatcctctccctgcggcgggaggacgctgtccggctcggctatgacaacgccgaaagctggagacggctgctcacctcctttgcgccggagatggccaaagctatgaagattccgtttcaggatttccgttggtacgctgtttttcacaacgagagctgccaccccatgtgcatatggtctgctacagcgcaaagccctcatagggttttctcaccaaagctgggatcacacagatcccttctcagattgcaggtgagattttccggcaggagctgaccgctgtctatcgggaacagacccatcacagagacgagctgggcgcggctgcaagagacgcactggaagaactcatcgggcggatgcaaaccggcgcggtggaagatgagaggcttggacggatgctggagcaactggccgggaagctctcccacaccaccggcaaaaaacagtacggttatctcaaggccccgctcaaaaagctggtcgatgagctggtgaatgaactgtcgcaaatcccgcaggtgggaaaagcctatgcactatggtatgagctgcgggaggaggtgctgcgcacccaccgggacaatctgccggaaaggttgcccctctcaagacagaaggagtttaaacagatcaaaaatatggtcatccgggaggcggtacggctgggagagctgaccgccgttttctgcagcgaggaaatctcagacgaaccggaggacgacccagtcccaaagggagagcggcgcctctggcggcaggccgcccaataccgcgaggctaagataattctctatgacgaagaaacgccgcccgaagaaaagcgggcggtattggcgaagctggagcagctctatgacggaggcttttctgcagcggcgcatttattgggaaaggtctatcgggatggcgctggcgtcgaggccgatgaaaaagcagccgagtggtggttttacaagtcggctgcggcaggcaacgactattccgaatacgctctcggcaagctgctggaacagcaggaacggtttaccgaagcggcggggtggtatcagaaagcggcggagcagaataaccaatacgcgcagtaccgtctcgccaaactgctgctcgatggcgaagaagtttcaaaggacgcggagaaagccgtccagatgctcaccgctgccgcagggcagaataaccaattcgctcaatatacgctgggcaagctgtatctgctggggaaagagataccaaaagaccgtgaggcagcggtatactggctcacccggtcggcggaacagggtaacgaatacgccaaatattttttggagcatctggacgactggcgcaaggcagccatttcccaaggggtggggcggctggtgcgtcatctggggaacctgtttcgggcgtcgtcagcccccggccctgccaatatcccacagattactgaccgcaagctgctgcgaaagctccgggaaaagaaacaggcgatgggtattaagcccagcggagagcagcaacagcattgattgaaaggaggagcgatatgggtggaatcatctactatggaaaatacaccaaggatcaggtggagcgggccaaccagatcgatctggaggagctgctccgccgaaacggagaacatcttctcccatccggcagagagaagcggttggagaacgaccacagtgtcaccatccgcgggaaccagtggttcgaccacgctgccgaacagggcgggtacgcgttcagttttgtgcggcggtactatgggctgagtttctcagaggggatgaagctgctgctgggcggttattctgtccagcggttgtatccacagctgaaggattggaacgatgacctgaaagaagaaatagaacagcaggaaacgtttgagcgggagcaggaaggaggaatgagctttgccctttgatttatctcagttggcccccctgctctggacagtgggcggcatggtggcggtgttcgccttcatcgcagtattttcagacaacgccaacctcaatggtatcaaatcccggcaagtaggcgacggccagcacggtacagcgcggtgggcgactaaaaaagagatggagaaagcctatctccatctccccttcctgcccgaacagtggcgcaagggagtaaaactgcccaaagagcagggctcagtggtgggtggtccgccctggaagcaaaagaccaccgccctcatcgacaccggcgatgtccactgcctcatgatcggcgcctccggagtgggaaaaacagcccactatctttatccaaacctggaatatgcctgcgcgtccggcgtcagctttttggcaagtgacaccaagggggacgtctaccgtaactacggtaccgtcgcgcgggagtgttacggctaccaggtatcggtgattgacttgcgcaatcccaccagaagcgatggggcgaacatgctccacctcatctccaagtacgcggatcaatatcatgcgcaccccgatgacctccgggcaagagcaaagatggagaagtacgccaagatctgcgccaagaccatcattcaggcgggcggtgaacaaaactacggccaaaacgcctatttttacgacgccgcggagggactgctggcgtcggtcatgatgctgatcgcggagttctgcccacccgaagaacggcatatcgtttcggtgttcaagctcttgcaggatctgcttgctcccagcaagatcaagggcaaaagccgtttacatctatctgcgcgaccgggccaaccgggacggtcaaagctggccctctctctcgaccatttccaaagatcttgcactctccaagtccaccgtcaagcgggctgttgccgacctcaaggcggcgggatatctggaaacggagcagagatggcggcgaaacggcggcaggagcagcttgctttttaagctgctgaaatgatggatggcagcaaaaaaaccacaggccacaccaagggcgaactgcgcccttgggtggactgtggtacggttcgttatgggctgagaaggggaagctcccagcttaaagaggacgatggacagagagaataataagacgtgttcattcctggtcctctcccgcttcttcttccccaaaaagcaatcggatatggttgtgtgaccaaattgtttcatacagcttttttaagggttcatcggacactgtatagcctgcccgcttgagcaatgtgaccatgatttcatatccagccaggtaaaaatattccacagaatcgtcaatggagcgttttttccttgcagaatgtccgtttaatttcttgtgttcctctggagaaaacgcatttgcaaaaaatcgccacgcctgtaccaatttctgctccttatccgcatgaccaggaatttgtttcagatcgactgttttaacaatctgtccgagcagatcgccggccgcattcagaaagccctgcgcaagataataacaactgataaggtcataatgatcacaataagcgtctagaagggcagaataactactcagcctctccgcttctttgggccaggaagaaaaattgttacgatactcccgatagctgggggagtatcgttgttgatagtgtaccgttgcacaggagatttcctctaatatactttcgaaaaattcttctgaaatcatatgcttttgagccattgcgtatcctccacttctatttatgaaaatgattaaatcaaacctggctccacacattatagaaatctcggagcagcttaaatcttcgctaatcggagttctccgcatctttcaaatcaaagatatattccagaaaatagctgcgggaaagtacctggtttgacagtttgaaagcattcatcggaagtcctaatttttggaaactcgggtcgtttttgatctgctccgtcaccagattgtcaatttcctgctgatgctgttcaacctcctgccgcagctccttccaagaggaatgaacggaatggataaaattcgcctgtactcgaatgaagtcaacggttttggggttctgattttcaggcgcccgttcataggatattggcccgacacaggctacgggaagctcccatggtgagtattgcgcattggtacggcgaggtgtgtatgtatcagttttgaggagcagatctacacagtcgctcagggttgaacctacctgaaagctgctggcagctttggtaaacgccctcatattgagtttcctgtgatgccacgtgtgccgaattcttccgcttgtttcccaacgccccgctgtatcctttttgtaaacctgatcggtgtcaaaataataggcaactcgattcgcaatgcggactggctgcatcaggatgccctctttcaaaagagcttgtgtgaccatgctccgtatctcatcgtatgaaaataggtccaatacggaatcaaactgcgtcagcagatatttttctatattgtctgccagagtactgtggagtgaaaatctggaaagggcaagatcccacgcgcgcttgggaatggcagccggcgcccaatatgtgtccggcagctccgttagttccggctgtttatctctttcgaaagaataccatagtttgttatctaatattgcggattcgttgcttttgatgtaatagatcaaataatcatctttcggttttcgggttaatagaggctgtccaacgataccctgctctacaaattgcctctccagctcctgcgctataacgccacggacgccgtcaatgcctctggatatcaccgtgctttttgatggacttgatctgttgtttttttcaatgcccattttccatcttcctttgtaaatttgttggtaataagctgtggattggcaaaacatccaataaaaagaggattatttatatgaaaagcgtacagctacagggactaaaaggggagataagttggtatacttacagttaagaggtgggggtgtgcaactcaataaagctgtaagtaaacgaattgagcagttacttgaaatgtatgacttaacacaatatgaactttttatgcggagcggtgttccaagatcaactattggaaacgttataaactgtacgtatgaatcggtaaagttgcgtgttatttatgagatatgtcaagggttcggtataggattggatgaattttttagttcaccacttttcgatgagaataatttggagccataatcctctcagcacacagtatgttgaggggattttttactgatttgatatgatatataaatacttttaaaaattgttactatttttaattatagtgcttaggttcccataagtcaacatagtatctcaactgtatcctgtcgcgagatacactttcctttatggggggattgggatgttcataggcgagaaaataaaattattacggatagaaaaaaatctttcacaagaacaactcggttcgctcataggagtaaaacgaagtgaagtgtctaaatatgaagctggtgagcggatacctccgatacatattgtcatttctttagcaagagtatttcgagtttcgacagattatcttttaaatgttaaaagttctgataaggataaacttatatttgatgtttcagaattaaccactaagcaaagagaatctgttgctcatatcgttttctccataattaaaggattcatagaatgattggagagatgtttaggtagaagttaggtgagtatatgcagttaaactataaggacattggtatgcggattaggaaagaacgtaaggctctttcaatgagccagcagactcttgcggagcttgtcgatctccaacctaataccatttcccatatcgagcgaggcactacaacagttcaactgcaaagcctcataaatattgccaacgctttacacgtaccgattgaacgactgctatgtggagtcactgtggtttcagagcaggcattgagaggaatcttagcggatgtgttaaatgattgtagcgcggaagaaatgcgcgtaattgtagatatgtgtgatagcttaaaacgaagtctgcggaaaaatatggagcaaagataggtaataagaataattccacttttattgtaaataaaggtggggttatttttatgtgtttgcctcttgcggagaacaaaactaattttgaagatttatcgggatgttgtgtgggtcctcagcgaacgggcggaggaactgcgggaatacgcatgggagctgggaaaccaggacgcagaaacgggcctgtgctatttggagaacttcgccccggatatggagctgtaggcatttgaggaaaaggtctgctgcgttgtccaaagcaggatgttggtggatgtgatcgacagggtcctgctccgtctcaagcggtatcccgaccgcggggagttgtattatgagatcctgaccaagcagttcatccatcgattctcgccgtcctcaactcggtgatgagcaaaaaggaggagatggccgggcagatcaccgacgctatgcggatagagctgctgtctctgcctggcgggacgatgagtatggcggacatcgaccgcaggctggcagagctggagcaagagttccaggccatgtttcagcggtccagagaaaagccggatgggtttatggaatacgcggagagtttccagaggatcaatgaggaagcggccaggctgaaggaacagaggaaatacattctggaccagcagcagagcgattcggcggcaaacggacggatcgcgcatgcgatggacgtcctgagtaccggcgcggcggaaatcaccgagtgggacgagagcataatccgccagctggtggatacggtgacagtgctctccgaggacagaatccgcgtccggctgtatggaggcatggagttcgaacaggaactggataaggagagaaactgatatggtctgcgcaatcgaagatatccacgacaactgcaaaaggttactgctttgagcagcataggacacttccatagcagagaaaagggcggcagctttgctgcttttttctctgggatggaactttgcaaataggctctaaagctagaaaggaggaaccggaatgaacatccgaaaagagatcgactacagcgccatgtataccgcgctggacagcctcatggaacaggaactgccgcagatggatctgtatagcgggattggcaggatcgtctgtggcagggccgagaaaggcgccgcagtcgccgcggcggaatacctgcgggcgaagtactcggatgcgtccggtttttccccgcgcaacctgcgccggatgcgggagttttaccgcgcctatgaaaacagcctcgccctgctgggtgaggccatgaggatcagctggacgcagaatgtggtgatcctggagtccggcctgacactggagaaaatgggctggtatattcgggctgtccatagatgtggatggacaaaaaagcagctgattgatgcgatttctacagaagaacatctttcatccctcgactgtcctctttcttcatgctatactgaggaggaaaatgaaactatggagaacgaggtacatgaccaaaatactatttatctgccacggcaacatctgccgcagcccaatggcggagtttattatgaaagacctggtgaagaaggccgggctggagcaagagtttctcatcgaatccgccgctgccagccgggaggagctgggcaacccagtttatccaccggccagacggaagctagccgagcatgggatcagctgtaccggcaagacggcccgacagctgcaaaaccacgactacgagaaattcgacctgctcattgggatggatcgccggaacctgcgcgatatgcaaacgatctgcggcagggattttgcggacaagatgcgcctgctgctggactataccgaccaccctggcgatgtagccgacccgtggtacaccggcgatttcgaaacaacctggcgggatgtggaggctggatgccgggggctgcttgaaagaattaaccgcagggaagcgtaacaaaaatggagaagttggttgtttgtggaacggaaatcaaagtgcagcgggctctcagacgggacgattgtctcagcttgatggatattgcaaaaattgaacagaagtcgaaatttggaactcaaaaatgagacatccaaatttcggctttttttctatgccgaaaaccgaggattcaagccacatttttgtggttgtcctcttttgtagaaatgggacatccaaaaagaaaaattaaaaaatcaaaatgtaaaaatgaaaatagatcaaatccgaacccggaattctcattttcttgaggattccttttcttttatccagtaatcctgctctgcctgttccggagttttatattgcagggtggaatgaggacgttcggtgttgtagaaggcaataaaatgggcaattcctctcatcagatccacttccgacgtatagtgcctgcgatatagctcttcttttttgaaaatggagaagaacgcttcggagactgcattgtcatggggacacgctgtccgggaaaaagactgttctactccaaagtcatccaacaggtgaacgaacgcatgggacatatactgcgttccacgatcactatggaacacgagctctgcctttggttgccgcctatctgcgtaggcctgtttaaaagtctttgtaagcagttgagtgctgcttttgtgcgagattcgataggaaataactttccgtgaaaacaggtctatgatgacgcagagataataatacttgtcacggaatttaaaaacagtgatatcactgccccagacttgattcggccgttcggtttggaactgctgcagcaggaaatttctgttctgccctttctcccatcttttgtattccttcttagccgtagtagtgacgctgctgattcccaactccttcataagctgagaggcatacttttgactggttttaaccccttgcttttgaaggatagcggtgatcttgcctgccccatagatttgttcgctatcgtcataaatgctttgaatctgcattttcaacatctctcgccgcttagctgcaagtgtgttgtctttcttattgcggaaaatatgattatagaaagtgccacgtgagacctccagggcgtcgcacagagcgtgtacactgaactgcccataaagcggctccatggctttgagtttttcctgcaaaggtgaggaaacagtacagctgaccgtctttaaaacctgaatcatatcctctaatttgctgattcttcttttcaagtataggaactcctgcggagtagctactgtgcccgtatcagttaccgtttgttgatagtcttgtatccaacgatagaaggtgctacgaggaatttggttctcactgcaaattgaaagcactgtttctccgtcctggtagcgtttgacgaagaccatcttctcttctttggtaaatttcatggggtcacctccttattgttttataaggatatggtaacataagtagtacataccttgagtgaatgtattaatatcttaccatgtcaagaaaagcatcgaacgaactaatttcatcagaaaatcttgactttacaaaagtttcgatactttagtatatcgaattattgaacgatttgttgtattttccaaagagaaaattcacttttgctccataaagaaaattcgatactacccatctttttcactaagatgcaagtaaagagaaaaaatgctggtagtttaagcgttgctggaatttctctatacctattttctcattgtgaaatattaatttcattaaaattacaataaaaatactcaataaaagtcaacaaacagcacatctaagcagagctcaaatacttgcaaacgcccgcaagtatttgcaagtatttgagctcggcatcttgacatcttaaagatttaactataaaatcaatgatgaaagtgtttaaataacagatttacgcaaataaaaaaggggtaaaaatgtgtttgaagataaagaacaaaatagaaagatggttatcggcgcatacaagaagttaaaatcctatttctattacgacaagactattttatataacaaaatgcgtcttgctacatgggagtccgatgaaattgaaatgaataaacgcattgaggatcttgctgattttttgtcaacacttgaaatggattgcgactatgagtatgtgaaactcttaatatcaggtgtgggttttgttcccatgcctaaagcttttaaagaaaagcccatcgaaaataatctgttgcagaataaaatctctgacaataatgagatagacaaggtgaatttctttattagggctccgatagaattaatgattatagacacgatttggatgttgatgatcggaaaaattgcttcagagcaaaattcaatatcatcggcagcgtatgcaaataaaattaaaaagcaaatttttttttcaagccatgatctctttgatggaattgactttaactcaaatcgactctttgtaccgtattttaagcagtacactatttggcgtgataatgctttccataaagttaaggcacattatgatgctggacaagatagtattctattatcattagacttgaagggatactattattccgttgccttcaaatttgatgaattgtctgaattgcttaattatgatgagaggttgacaaaacttgccccattaactgcgatcattgaaatggtgtatacgatctatacatctgaaatgaaaaaatatcgtaatgcaattagagcgaatcctgttataaaagagtgcatctttccaataggtctgttgagcagtatgcttctttctaatttgtacttacaacattttgataaagcaataatggcacagatacaaccgagttattatggaagatatgttgatgatattttggttgtcatgcaacgatctgaagatatgactatctcggttgaaagtattttgtatgaaagtcttgtgaaaaataatatcattaagcctatcggaaacaatgagtaccaaacaatcaatccatttggacttatatttcaaaaaaacaaaatgcggtgtatttattttgatcatttggaatctgatgcaatgattaagttgttgtgtgaaacaaactccaatacgcccagcagtgtcgaactaatgcctgatgtaaacatatctcaaaggacatttgacgaaagtgcatataaccttgaacagcagtcaggagcattaaaggtacgcaactttttatttacaacaaataactatgcagcaacactatttgtgaacgatttgattagaactagcaagaatgttgacacaaaagaatctgggtatcaaggatatttaaattctcagattaatcaaattatcaaattttatagtggtacacagtccattgaatatcggagcgcatgggttaatgtatttacacttattttgctcactgaacaatatgacttgttttgtaaattttattaccaaattcgtgatactattgcaaatatgactgccgtttcaatcgaatccattgcactggagaaaatagagacaatatgtgatagtatacgctatgcgatgacagagcaactaaatctttcggtgtctattgcattagctccaatggctattactgaagttgcaaatactattaaggacgaatttaatcagataggagttgatgtagacaacattgttcaagatgctcgagatattcgtaatgccaacttgtttaatagccatgttctttccttaccattgattaactatgtcaacaataataattcggaaatgtctctagttagggcgctgcctaaagatgtcgtgaggtttacattaaatgggaaaaaaactttatcattaaatcaaagaaaggtgatgctgtcgccacggtttattcacttagacgaaatttgtatgttgaattttcttgtgaattttacatccggaggatgtccgtctgctggaaatctttgtagattaattaataaattctatgaaataaatcaaatccattctacagttaaagaatttgcggtagaaaaatgtgataaatttcaaaaatatgaattaaatttgcagcaaatcaaaattgcttcaccaaagggaaaaacatttaaaaagttacgtgttgcaattgcgagtatttgtctagatgagagtaaagatattattccaacaatagataatccaaagcataacttgacaccttcaaaaaaagctgagttgtatgccctgctcaacgaggcagctaacaatggtgctaatatgattgtatttccagaattctttttacctgttgagtggcttgaagaagtctacacattttcaagaaaaaatgcaattgcagtgataagtggacttcgctatattatctatgatcaacacgcatataattatcttacagtaatccaaccggcttcatcaaatctaggttttcgatatgctcttccgttaattagagaaaagaatcactatgccccggcagagtttgaaatattgaagaaacatggggtgatgtgtgtagatccaactgctccatatacacatttgatatcttggcataagatttgttatagtgatttgatgtgttatgaattaaccgatattggatatcgatgtaagcttcgctcgaaaattgaattgcttctagttccagagttaaaccctgatactgaatatttctctaatatcgtggaagctacatctcgagatttacattgttttgttgcgcaggtgaactcttctaaatatggtgattccaggattacaggaccgtttaattctatgtttaaggatattgtaaaggttaaaggcggcgaaaacaatgtcttactcatgggtacagttgatgttaaagaattgtttgagagtagatctggaaaagcggatgaaaaagaagaaaaaccgaagccactcaagcgtaggataaagaagccatctgcagggtttagcgtaagaaagggggggagttaagtgaatacccagaatgagtatataattgaaaccgtaagaggattgttaaaaagtagagataacaactgtatagtttttctggatgaaacaatcgattcagataaaatagggagatatattagtgcattggccaatcaagctgtactctactcttgtccttatgcgtatgcgctatggggatttgacccaaagacgcgaataacagtgggaacaacctattccatcgatcaagattcatttatcccattcttgtctacaaatgctgttttttcctttcaaacaattgattatgaggataagcgcatagcagttttggaagtgcagcaagctactgaaactacgatccaatacaaaggaaacgagtatattctggatgaaaacagaccagagaagcttggaaaattccaagaccgcgaaaaacaaatatggcgccatttagatactcctataaccttcgaagaaaaaccagcaatggaaaatgtatccttagaaaatctgcttaagttattagattgcaacaagctgtttgaattgttaaatctatcatatcctaaaagcacgatgggggttattaacgcattgttaaatttgcgttttgtaaaagaacagaacacaggtaaatacacaattacaaatctaggagcactattactggcaaaaagattatcgtattttaatacagtgcagttcaaagcggtccgtgtgattaaatatgatggcttagatgttacacagcctgctcatgaacaagttggtggaaaaggctacctgattggatttgagggactaatagactatatcatgaaatcactcccgaagcacgaagttattgaaggcgcgttgagaaaaacggttagtgattatcccttattgtcaattagagagcttgtggcaaatgcacttatacaccaagacttaacaataaatggatgtcctattatttcaattttttcaaatcgaattgaaattacgaatccaggtattccgttagtacccatagatcggtttattgatactcctccatgctcaagaaacgagttattggcatcggtaatgcgaaaaactggcatatgcgaagaacgtgggagtggatatgataaagtggtctcttttgttgaacagtataatttaccagctcctcaaataatagtctatgaaaaccacacaaaggttgtccttagcgcaagaaagagttttgatgaacttacaaaggatgagagaatatgggcatgttattatcatacgtgtttaaactatgttcagaaaaaagtgactaataatacttcactccgtttgcgatttaaattagatgaaaacgagcgatataaagtctctcgagtattttcagattctgttgcttatgttaaacctaaagaaggaacaggtccgaaaaatagagagtatcttcccatctgggctgaataaaaaattacttacctccatttgcagatagatactgtgtcttacacggaatacaatatatagtgctatatatatattgaatgttagcatattcagtgtatagaaaaccgtatttatttgcagattgaatattgtgattttttattctaaaaggttgcatccagaaaagtcttaaatacatttatagcgctttattctgaacctaccttttctcattctcagcgggtatctattttgtacacacttcccaccagactgagtctggacgcaattcgcgttccaggctcttttttttatcgaaatgagcggctcgcgttccagtcgatctaaactgaccaccttagccaaattagacaaaacccatgtataacatcgttatatatgggttttgttatttttatggtgaaaggcacaaataaatacacttcaattgtgcaaaacaacaggacaacttaaatacaaataacaataaggtttcatattcctatgttttacctccgttagcagaggtaaaacataggattttttattttaaggaggttttaaacatgagaataccatacggtttcaatctgacaacatccggcgcacttgagattaatgaagctacagccaaagtcatcaaaaggatctttgattcttacatgaccggagcaagcttaggtaagatcgtggaaatgctctctgcaaaacagatcctttcccccacaggaaaatcaaaatggacgcgcgcaaccattgatcatatcctctcgaactccaaatatattgtcatcgttggcatggaaatgtatatggatgtacaatttgaaaaggctgtccgctgcaatattgattacgatgaggtcaatacacctcgtaaatccagccgatatgcttcgccctctgtaattcagaaatcattttgattcccaatcttcaaaatatctgttacaatagttttaggggtgatccatgtgacagatgagaagaaaaaaggaattcaattagtggatttggcagggatcggcaacttgttggagcatcttgtatcggctggctgtatctcctgtgaagaacgagatagaattatatgccggatcgcacaagacggcaatttcagtgaggtgtccctttctgtgcttgccggttataggcgaagcgaaaaggatgtgtccgagagacctacgcacagaaaactttcggaagtattaccaacatgcagtgcgttgaatgaagaatatgtatctctaacagagctggtacgggcgcatagtgaaggcacaccaggatatgtgattcaaagctggctgcgaaacgagaatacattggcatttttgaatctgtgggagaaggagaataacccaacctattgtgaacatgcttatttagagttgttggagaaaaagaaagcggctccctttacactaacaccaaagcagtggatcgaccagacaaaagcgatcggcatcgtatcaaagcagggaaagcaaggaggcacttttgcccacccaatgattgcctgtgaatttgcttcatggctcactccggagttcaaaatgctgctgctgaaattatcgttgatcaaggctcggttggggtgaagaaaatttcttatagatggatttcgtagcggttagagaggttttcaaaagacaggagcgttggaaatgaacacaaaactgaaggatgcctgaacggaaaatgctgaaagtcggcagtatgtggaggttggagttcctcaataaaacaaggaaagagatatgtaaatggtatcgaatatgctattttaactgacgagatctctcgcgtatggtgaccactcgccatcaatacacaaatctcaagagcttcaaaaggaaatggataaaaatttaacagcaggaggagatgcatagtgaacatacaggaatttatttcaaattaccataatcatccggtactatttgttggtactggattaagcttgcgttatttagaaaattcatacagttgggattcattgctgaaaaaaattgcatccgactttaattcgaacgcagagtattatcttgatattaaagctgagcatatgcaaacaactagctatgctttcgatcaaattgccacccagttggaaaaagactttaaccagcatctcaaagataaccgtcatggaaagtttgaatacatcaacgaccttttttatgcaaatatgcaaagaggagctaatattagcagatttaagttgtatttggctgatttgctaagaaaagtgatcataaaagatgctgctttacctgaaatatccgagctgaaaaaagctcgcaaaaatataagctctgtcattacaacaaattatgatactatgattgagcagttattttcatttaatcccctgataggaaataatattttactcagcaacccgtatggctctgtgtataaaatacacggttgtgtttcacagccagaaaaaattattattacagaaagtgattatgaagaattcaatcgcaagtatgaactaattcgtgcacagttgctttcgctgtttatccataatccgattatttttatcgggtataacattggtgataaaaatataaaagatattctcagaactattttttcttatgtggattacaattccgatgaagcaaaaaagatacgggataacttcctcttaattgagtacgaaaggggttccgaaaacacggaagttatagagcatgacatagatatagaagggtttgaaaccatccggataaacaaattaaaaacagacaattttgtcgctgtataccaagcactggcaaatctctttttaccagtttcggctatggatatccgaaaagtacaaaccgttgttcgagaaatatgtgagggcggtgctatagaggtttctgttactgaagatttggatgaactcaaaaattcggataaagttcttgttgtaggatcgaagaaaactatcacatatgaatttttaacaacatcagaaatgatggtgaattattttcaaatcattgaagaatccaactcacagttattgcgtctcttaaataagcaaaaaatccagtcctctcaatatttcccgatatatgctttttcttcgatatgtccggaaattaatagaagcgaagaactaaagcgacagcagcgaaataaaattgatgcacttattgcagaccatccgcctgcatgttgtggaaaccacttaaacccgcaagctgttatcgatgacctgcaaataccacgaacttacaaaacattagagatgatttgttcaattatgtcaggacaaatggatttgaaacaggttgagccttaccttaggaatttcccagataagcgttcaacagactatcgcaaacttctgtgtgcatatgatttgaaaaataatgtctaaagaaaacaaaaagatcgtttccccctatactaagcaaatggacggttgatggatgcccagcataaataacctcttttatatagcaactggtaatagttccatacactctcatagttgatccattttccagtatttttgtggaggagatcggtagaaaatttccggattattagaattttccgtctaaagtagtggcagtgtccagggtggttccaaactgggcagacttgtcaagtgggaagctgcattttagcctagtagataaggccaaaatgtagcttttctctatgcaattttccgtgaagaaacctccatgttatactgctcataagtatatgatttgttctttactttgcggaatatatggaggttttgttatgtcaaaattattatagagattccacaaagtaaagaacaaaaaaccatttggcatcagcaactcagggttgccgcctactgccggatcagtactaaccataaagaacagcaaagtagtttgaaaaatcaaatcgagttctataccgaatacatccagagcaatccctcttggtaatttgttgcggtctactacgatattgcatccggtctgcgaacaaacacggcccggtcaccagcagttaattagagactgcacaagaaaaaagattgacctaattatagtaaaatccctcagtcgattcgggcgggatacagtggaaacaatcaaataaatacggaggttaaaacaaaaggatattggcgtttattttgaaactgggagtatcaacactctgactaacaatgatagagtaattgacatgttggcagctattgatcaagcagaaggccaatcacgtagtgagaacatcaagttcggcatccgccaccgtatgatgagcggcaagacacttcttaaccacactcggttccttggatacaccaaaggaccggacggggtgttacagattatcccagaggaagctgatatcgtgcgaaagatctttgacctctttgtacgggggaatggtgtacgcaaagtcaaaaagtatctggagtcccatgacatcaagactgtcaccaaaaaatcagagtggagcacctccactattgactggatgctgaacaacgagaaatacatcggacaagtgctgacgcagaaaagctatacgccgaattttttgactggaaagaaggaaaagaatcaaggacagcttgctatgtatctggtggagggtgctcatgagcctatcattgaccgggagacttttaatagggtgcaggagatgaaggatcagatcaaatacgcagtacaaatggggcatatgctgtgatatataatcaaaagtaaaaatgttgatatgacttacttatggcgaatctaccacaattacaaatcaggtgtctggtggaagctattgcagcatattttagattatcaaaatatataaactatcgattttagccgtcctttgcataatagataaacctgtttcaaagataatcagaaaaatcaagaatatgctagttttctcttgacaagaaaaataaataatgacacaatgacaatgacattacatgtcattaaacggaggcggattatatgtcacaacgcacagtaaagggaagcggcgaacttggaaataagatccggcaacggcggaatgagcttggacttacaattgaggaagcggcggcaaaggccggagtgggtgtaaaaacatggtgcaggtatgaagcgggtgaatctattcgtcaagacaaatatttcaaagtatgcagcattttgaattggaacaattcccatcaaaaaggcgatgatgaagaaaatgtatttgatgtagagaaaattcggaaggaaggtgtgtggtcttcgttccttgaggaaaatttcggggaacaggcggcattatcctttgctataggaagtggtattctgttggatcatctaaaaatggatttggaagagctttctttgaagccaagaggaacccatgtaggtgaactgaatgtttcatggattgcagcagacttgccgtcacagtttctcatggaatatgactataattttttataccgattgaagtctgttgtaatccagtactgcaatacagctaagcgaggggagacgatcattgcgcatagtgtgttggaggagttggcactgtatctcataatggaggaatcgtcccttctcatggaagcgttttcctcagaggaagaaaatgaagatgtgagcagctggaatgcatgggcatttgatctttttgatgatatggatattgtcacttttttgtattctgattcctatttggatgaacaaaatccctatcattttgatcattggcttgaaaagcagttttattgtgaccaagagagatgaagaaactgttcggtcaatccgatcatacttaccgacctgattgatgaggcgaagaatttgtcaaagtgtttcatctgtggtgcagaatctatgttacgatttgatctggaaaacggttgtagaagccaatgttgctgtcgcagcagaacatcaaagaaattcttgcaaaagatggggttgaatttgagaaacctttattgcaagctttgcgttcaacaatggagaagattaaaataaagcagctgaccgagcaagtatggaatgaaatattcagaatatcggatgctgttatccagagtgaataccaacatctttattttccggattattcgcagagaaaatgattcaaaaactttatattcctcggtcgagacagtaatgactagcgaaattaaatcatagtttctattgttagtacgagctccaagctatcagacaggaattcggagccaatccgcgctctgagtcctttgtgttacgccagtattgcgcccgtgtctaaaacagacataaagcgcccccgttgtagttctatcctacttcgggggttatttctttgcaactgccctttagcccaacgcagttcaattgccggcgcttttatttccttttataaaattgtagcatcccgtgcatattcttctaaatatttgctgtaatcagttaagaattgctccacgagttcgatctcactatcggtgtattgctccaacttttcggtgagatagatattttccatccgatgataagcatcatgagtatctacagcaattttgccgcgttcagtcaggcagcaaatcagttcttttttattgcggccttgccggacggtgagcagttttttattttccagccgccggaccaaaccggaaatcaccatcttgctggccatcatttgatcagacaatgtggttaaattacaatcgggatgcttatcgattagatccaacaaatgtatttcgtctgttttcagaagaatatcaatgccataattgcgcggaagcgcatcgctggctttttgaatacgggccagatgatcaattaaggagcgaaaaccataaggctttttcatcagaaatgcaccttccgtgtgtgtattgtttccattatagatgtatatgtacgcgatgtcaatttaacagcattacaaaagaactgtgaaatgcaattcaaaaagtaaatatttttatattttttatttttccaaaaaattcaaatagttttatttttaaaaaattatatttttttaaaaataaattgtgagaattgccaaaaattaaactagaaagctgtaattatcatgcattgacaagtatcttctttaaaactatacttttaaatagtaaatatatttacaatttaaagactcgttgaagaattattgaagcaataagaggaggattccattggcggtaagatttgacaacgacgcgatccgttttgatgtgctcaggcagcgcgcctataatatgagatgggctgaacaggatacgggagtaattccactcactgctgcggacatggatttttcctgttctcctgatattgttcaggcaattgttgaatatgcgcaggccggatatttttcttatacacccaaaaccggtttcccagcgtttaagcagagtatcgcacgcgcactgtgggaaagaaaaaaagaacctgtgaagcctgatctggttctgcctatagacagtgcagcgcgcgccatgtccatcgttgcaaaaacggtgcttaatcctggcgacgaagccattgtatgtgatccagtggattatctgtttaaaacatctatggaagccgcgggagcaaagattgtactgttcccaatgagtatcaaagatggtcgaatcgatttttcccggttggaacaatatattacacccaaaacaaaaatatttgggttatgcaacccgcataacccgctgggaatgtgttatccgctggaggatcttgattatattcttacattgtcgcaaaaatacggcttttatatcatgaacgatgaaatttggagcgatatcgtttactctgacgcacaattccacagtatcttggaacttggacccgaacgcaatgcgagaacgctctcggtatatggattttcaaaaagttttggcattgcaggtctgcgggtaggctgtctgtatggcatggaaaagaacttgtttgagcatgcggtggatatcagcgaagtgaacagcacaatcggtggtatttccagcttatcgcaaattgcggggatggcgtgtttagataaatgtttcccctggctggatgaatttgtagaacatctgcagaaaaatcgtgattatgcgctggagcggattcggaaaatgccgggtatcagctgccataagccccaggcaacctttgttttatttgcgaatatcagcgaattgtcaatgagtgctgaagcatttgttgactttgccaggagggaatacaggatagctgtcgtccccggaggcgagaagtttttcggcccgggttcggaggggtatatcaggatctgtctggccacaagtcatgaagtgctaaaagaagggttgaatcgtcttgagcaggcattgacagccataaaagaagggcggcacaccaatttaatgatgtaagtaagaaggagagggagaaccatgttaggaaaagatgtttttaatggcattccgatgatgatcctgtgcgtactggcaatgataattgttgtaatccagccgatcctgttcctgtggctttcatggaaacatgggaaagagatggggatcaaaacacaggatatgaagggctgcgtacatagtagcatcctgttttctatcgtacccacgttaccggttctaattaattatttggtgctgatgcctgcattcggaaaatattttgcctggctgcgtttgagcgtgatgggcaacgcagcttatgaaaccgctgtggccgatatggcggcgacaggactggggtttgaaagcgtttatgataataacatcgatctgcaaacattcaccactataatgttcgtggtgacgatagccattttgggcggcgcaatttttacgatgctgttcactaagttttatgagaaaaaagtacgtactgtggctacaaaagtaggcggcggcaaaatgatcggcttaattacgacagccatgttcgtaggaatgtatagtactctggcggctccccatgtgacgaatgtggaaaaaccaaggggaattgccgcttttattgtagccgttgcagtcacaatcgtgtgcacgcatatctctaaaagatgcaagagccttaaacagtttacttttacgcttagtatcctggcgggtatggcatccgcttcaatcatcagcctgttttaacagagaaacccaatgttcagtaaggaaagaattcaagccgtaattgtgttttggtatgatcatccgccgatatctgattaagctatgaaaaagttttaaatgaggagggttttgtatgaaattaacaaattttaaccaaaaggttcatttttggggcaggctgacaattttgatctgcatgattggcctgttggctgtccctctggggattgcggtattatataatgtacaagtgtcctggtccacggtattcagcgtatctatcagcccttttattacttataccatttccagcgtcatcggcctgcttgcactggtgcccgtcatcggcggaggcgcgctgtatgtggctaacgtaaccggcaatgtgaacaatattaaagcgcctgccgccatcaatggtatggatatctgtgatgtagaacctggtacagaacaaggcgataccgtagccataatcgctacgagcgtaacggcgttggcttctactgtcatcatggtaatgggtatgctgtttttggcgcctctttttcagccgatatatgagaatcctgtttttgcccctgcttttgacgtagtgctgccgtcattgtatgccgccatgctcacaccatattttcttaaaggtgtaaaggaatgtatcgttccgtttctcctgcccatcgtattgcttctcgtcatgagccgctcgctgttttcctcttggtccagttacatcatgctggcgatgatggtggtgtctgtaggttatgtgtacctgctgcacaaaaaggactccggccaaagtgctgaaaaaatgcagaaagaggactccaaaacagaatgacatctttatagcggaaaggaagaatgtatatgagaattatcaaagcagaccgtgttattaccggcgatggaaaaaccgtattggaaaacagttcagtggcgttggatggcgctcaaattgcaggcatagggacgctggaggagctgcgtcagaaattcccccaagctgatatccatacgatggaaggccattcgctgctgccggggctgattgatatgcatgtacatatcagcggcctgtaccgccgccctgagaagcaggagatgcaggaaaatcccgcttacttgatgctgatggtttacaagcatttgcaggatgccctatctgtgggtattacaacgctgcgcggtgtgggcgaggccaagcatatcggcgctgccattcgcggagggtatcgtaaaggctacatcaaaggcccgcgctatatcacctgtgaacgcagccttacgcgcaccggcggccacgggtctacgggcgaagtggctaaaatagaagtggatggcccgtggaatttgcgtcatgctgtgcgcagcaatatcaaagagggggctgactggatcaaagtgatggacagccatcgcggccacttcagcgagttcacactggaagaactgtgcgcagtaacagatgaggcccatcgtctggggcataaatgctgtattcatgccggcacggagcaatcggtggcatgggcggtggaagccgggttcgattccattgaacacggcgcttatttggaggaggatttagcgcaaaaagccattgaaaaagggctggcctgggttccgaccatctatgtgtatgagaattctgtggactatatgaaaaaagtaacgccgaacccgacaaaggcggatttggctggaattaaattccttgaagacaccgtaaaagggtatcacagaaactttctgcgcaactataagaaaggtattttggtggctgcgggtacggatatttgcttcccggaaatgttcattacgcctttgcaggaggaaattaaaacaatgatccgctatggcctgaccaatttggaggccattcagtgcgcaacacagaacggtgcgaaagttttggggatggctgatgaaatcggtacggtcgctgagggatattgtgctgacctattgctggtagcgggcaatcctgcggaagatatagacgctttggatcgggtacaagaagtgtaccggaatggtgaattggtgtatagcgcgaataactgaaaaatgaaactgttaacaggaagccgggagtatttactcccggcttaacttgtataaaaagtctgtaccggcaattgaaccgcctcagattatataggcagcacacaaaaaagcccctgagcggaaatattcggttatagcagaagtggcgcagaattaattgagtggtatcgccgccgggagagcagcgtggaagatgcgctcatcgagatatatctggctggcgtatcagtccggcgggtagaagatattaccgaggccctgtggggcagcaaagtatttccctccacttttagtgagctgaataaaaaagcgtatgttcacattagcgattatcggaaccgtcccctgcaaggcggacgttatccatatatctatgcggatggtatatatatctgtgccgcaactggggcggtgagcttgagaatatagctattctggcggcaattgcagtcaatgaagatggataccgtgaagttttaggcgctgcaaagggcatgagagaggataaggcaggctgggtcagcttcttccagcggctgcgcagccgtggcttggacggggtaaagctggtgatcggagataagtatcaatgtattctctgtgacacctctctccaaggtgaaactggtagctaaaatgctcaggcaattcacgcccaggagaacaaaaaagctgccagggagaaagccaaagccgtcatagaaaaacttcgttctatgaaactgaaggaggcagtcaaaaaggtggaggatagcattgaggagactctcacctgctgcgatttccccagcgaacactgaactcgcatccgcaccaacaatgtcattgagaggctgaaccgggagatccgccgccgcacctgtgcggcaggtagtttcccggacggtaactttgctctcatgctggtctgtacccagctgcgccatgtggtggggtaacaagaaatgcatgaatatgaagcacttagaggctgtcattgaggatgcctctattgccggctgactttattcatgccaagatctgtaaaccaaagcgcgaaaaattcttgacacgacctacaatgcggagtatatattttgtcaaagcttcccaccgggcaagggcctggagctacttcgcgctccgggtcttttgatttgcccaagattttcgcccgcgtctaaggtggagctaaactgaccacccctggcacgtttgaatggactgcgctccattcaaaaagcccggtctttgaccgggcttttctcataccgctccgttttgcatggtcgctactgctgccgatttttttacttttcggtccctcttatccgcatttttctcctgtgcggtcctgtgttcatccacaccgctagtgcggctttcagaatccggtagccccggcctgtccggacagccgggagcggtccatcggcaatcagccggtggaccttcttgcgcctcactcctaggatctcctggacttccccggtgcgcagaatctccgaccagtccgccaacatctcccgtccaccaatattattctgtcccgtccattacccctttccaagaaaaaaggcgaaggcatttgccttcgcctttttcagttctctgccgttttttccggcggttcctcacccagcagggagcccatcataccagtcgattccaccagtgccctggatgccaggtgcgtttttatttgtgcaaattatcatacattatcaaactactcgttaggcgtatggttttcctcatacaacaaggtggtatgctcccgaaataaggaacataccgccttttgttatcaaaaacctgttttacaagctgcatctgtcacttgataattgtctcggaaggaaaatcttcactccagtcaaacaaagctttcgatttgtgctggcggacatattcttccacttctttgtacattttcttttcaatcatagaaaggatcgtcaaatgttcctgataggaagatgccatgcgttgcggcgtaacggagaaaacccgagttgtaaaatgccatttattccaaaccttatgaatcaaatccaaaagatctgcattgggcaggtgctcataaatggtactgtgaaaacggaagttcaattcagaatataaatcgacgtcgttactttcaagcgcagcatgcatttgttcgttgatattatacagttccctgatatcattgggagaaagataatcgatacaaacccgggtggcgtatccgcccaggacactttttacttctgcaatatttaaaatagtttcccgcgtaaaaccaactacgatggcgccgcgattcgcgctgattttaacatagccgtcgctttccagcatacggagcgcttcgcgaacaggagtctcgcttgtgttgcattttttggaaatttggctgattacaagacgctcgccatttttatagcggcgctcaattagctctgacatcagatattcgtatacttcgttcaccttggtcagttgctttcccatggtattactctccaaaaatattttatactaaaataatatatcaatattatatctaagaaagattgctaattgcaagtgctaatttcgtttctgtaagtgtcattgtgcgacaaaaaatgacaagttcattgtgtagaattcacaaaaattagaaaattgtaggaaatgagttgcattgagcggattatatatatataataaagaaaatatatgatttctatatattatatatttttttaatgagatttattgaaattattcaaaaaaaacgtaaaggaggcatattatgaactattattctgaaaacaaatggtgggcaagcccattcaatgaagaaaaagaagtgcgcgcacaacttcaaatggcaaaacaagtcaagatccatgatgcgaccttgcgggatggcgaacagactcctggtgtggtattctctatcgacgataaggtgaaaattgctgaaatgctcaacgaaatcggtgtggagcggattgaagcgggaatgccggcagtatcatcggatgatgccaaagcgatccagttgattgccaatcgtggcttgaacgctgacgtttatgcattcgtccgggcaatgcataaagatatcgaagttgcggcggaactgggggctaagggggtaattattgaaatccccataggttatccaaaattaaaatatcagtttggttggacatgggaggatgttgctgcaaaaagcatcgactgcatcaactacgcaaaaagctgtggactccatactgtgtacttcccttatgatacaactcgggctcgcgcagaggatttggaaaatgttatcaatactttgatgcgggaagcggttccggattccatcggcatagtagacacaatgggctgcgctctgcctgaaacggtacaatatctggtccgaaagttgaaaaggcttactgatggcctgcctgttgaagtccatacccataatgattttggtatggcagtagcaactgaatttgctggcatcgcggccggcgcagattgtgtacatagctgtatcaatggtttgggagaacggaccggcaatgccgctttggaagaacttattgtcggtatgaagatcctgatggggctgccaaatgaatataacctgagaatcctgcctgacgtatgcgagaaagtcgcgcagatttccggcattcaactggcccctaataaacctgtttcggggatacgcaattataccagagaatcaggcataggcataaatttggtgcgggaaaagccgctggccatgtttgccaccgatccgtcgctttacggaaagtccggcatcattgcattaggcaagaaaagtgggaaagcttcggtggaatattttttggataagctccatctggaagcgacaagcgatgaaattacagagattcttgctcgcgtaaagtcgatggggcaggaggaaaaaagattgctcacagaggaagaatttttggggatctatgagtcggtacgaaaatcagcataagggtatgtaaacagcctggccaggctggatttttccggtatttacaactgattaataaggaggaacagaatgtgattgacctgataattcagaatggaacgctggtcatcccggagtgcggccttgtggaatctgcagtggcaatcgaccgggggaaaattgtggggattggcgattcgacgtgcctcccgcgcgctgcgcgcattattgacgccagggggaaatatgtaattccgggcgtgattgatccgcatgtgcatttgggcacaaatccggaacagttctcctcccttgccgtaacggaatccagggcagccgtcattggcggtgtaacaacggtgggctgttatttgcgcgataaaggcagttatctcagctcttattcggactatatggatacgatccgcaatggtgtttataccaacatgtgtttccatgtgcagatcagtaccgaggaacatctcagcgagttaaaagagtacgcggagaagattggatccaatacgtttaagttttacatgtgcggaaatgcaggcattgtggagagcgccagcgatggctttatatatgcaggatttaaaaaggtcgcgtctctggggccgaatgcgctggcgactgttcatgcggaaaatgaaagcgtgattgaccgttgtattgaagaagcgaaagcccaaaaggaagacggcggcctggtggactggtatctgacgcgcccctcttttgcagaagcggaggcggtcgttcgggccgcccagctggcaaaggctgcgaacgtaaggctttactgcgtccatatgacatccgaagcagcgatgcggtgcctcaaagagcttaaaaagaaaaacaggaatctgtatgctgaagcgacttcagcccatctgggcctggatgcggccgatccaattggtttgatggcaaaaatgattcccccgatccgcagcaaagaagacaaggaagccttgtggcagggagtcagggaagatattgtcgatactttcggaacagacaatgtaacaaggagcctggcggataagcaactggaaaaggggctatggggcagtaaaaccggatatgccgttctggggacccatttgccggtccttttggacgagggataccataaacatggtctgccactgaagcaaatcatccgtaaagccactatggcgccggcaaaaatctttggtatgtatccccaaaaaggaacgatacaggtgggatcagatgcagatttggtgattattgaccttgatatggtgaagaaggttgctcctgccctgattggttcctgcagcgatttttcgatattccaaggaaaagaattgaaaggctggccaatcatgaccatagtgaatggtgaagtaattgcggaagatggccatctgacccatacaaaaggaaatggtagatttatcccaagacatgcataggcgattttgaggtgtaaatcatgcagcttacaaagaatgtccatgtagaaacaaaaatttggggatgcaatatcggataccttttaacagatgaagggagtatcctgatagatactccccaaagaccaacggtagcaatgcagttaaaagagacgctggagtccttttcacccattcgatatattatcaacaccgaatgccatcgggatcactttaccggcgcgggctttttcactgcccccgttattgcccacgagaatacaagagatgccattttaaagacaacaaaggaaaatgtgctaagccgtgtgtccgttatagacccggagggatatcagctcatggagtcctggaagatcaatccgccggtcattactttcagcgaaaagctcacccttcatcttggcggcagcaccattgaatgtctacaccatccaggacacacagatgggcaaacaagtgttttgctcaaggaagaaggggtactctttacaggagataatgtatttttcaaaacgcaggcttttctcaattctggtaacgtatatcgttggatggagtcgctagatgagattgcgaaacctgattttgaatatattgtccctggccatggcgaggtctgcggcaaatcttatctttcagaacaaaaagaatttattgcagagtggatacaagcggtgagaagggccattgacaacggctggtccaaagaagaagctgttgcaagaatttcctttgaagaacgctatcctatgtcgataggaacagaagatctcatgaagaacgtccaaaaaaacaatgtgtcgtatttatatgacatgctgttaaaagaatccgttgtctcaaaataatttgaagttgtccaaaaaggagattacagaatgaaggaattggtcgtcagtaaggacttttttatcacggatgatttttcccagtcatataaggtgggaaacctgctttttgtttctggtattacagccagaaacaaaaagggagaaatcatagaaacagattttgaggcgcagacggttcgaatctttaagaatattgagttgatcttaaaggaggccggcgcaacgctggatgatatcataaaattcactgtatatttgaaagatatgaataatgttaagcttttccgggaaatcagaaaccgattttgttctgttccgcgcccagccagcacggccatcgaagtaacgggacttgtccctggcgcaatcgtagaggtcgaggtcgtggcagaatgcgggggatgctgatacggaaagggagcatatggaggagaagatatcattgacattggcctgcggcgactatgaccgcacgcaggcgttgctgaacgggctggttcccataaaggggattgctctgacgtgttttgcgcttgagccgaacgagacgttccgcaggatgttggggaacgaggaattcgatgtctcggagatgtcgctgtcaaactatgtgatggaacgcagcgaagggaattttcgctttacggcaatcccggtgtttctttcccgtgccttccgccattccagcatctatgtgaacgcacgcgctaaaattcgggaagccagggatctgatcggtaaaaaggtgggtgtttccgaatatcattccacggcggcgctctggatccggggtatcctgcaagatgaatatcaaattgacgcatccaaactcagatgggtcagcggtgggatggagcggccttctgaaggcgaccgcatgaagaatttcatgcccccgccgggagtgcggatcgaaaaatccggaaccggacagtgtctaagcgagttgctgcgcgcgggaaaaatcgacgccttaatcaatgcgggcaagcccagttgtttcgacaatgaaacggtatatcggctttggccggactatcggcgtcgcgaggaggactattatcgacggacaggcatctttcccatcatgcacaccgtagtagtcaaaacaaagatcttagagaaatggccgtggattgcgaagaagctttttgacgcgttctgtgaagcgaaaaagatggcgcttgaaaagctcaatctgaaagggacgcttccggtcatgctgccgtgggctttttctgagtacgaagaagcggaaaactttatgggaaaagacttttggtcctatggccttgtgaataacggcaaagttttgaaaaccgttcttcgctactcatatgaacaggggctaagtaaaaggctgatggatccggaggaactgttcccaacttttgagtaagacaaaatgaataccattgatgaagcatgatcccgcgacagtgttgcctgtcggggaatgcaataaatccggtctgaaaaatcgtaagaatggaaggagatttagaatgaaaatttctaggaaagcaattgctttgatgatggccgcagcaatgatcgcgacactgaccgcgtgcggagcgcagcccgctgaaaacagccaagaaaacagccaaacggaagaaacatcgacctataccattaaaataggacatactcttgctacagccactcctcagcatcagggccttttgaaactggagtccctggttgaggaacgcacaaacggcgctgttcagatcgagatctatccatcttcacaaatcggtgatgaaagagaactggttgaaggtatgatgatggggacggttgacggttatctcggttcgaatgcaaccatgactgcttggctatcggactttatggtctttgatatcccttttatctttgacagctatgaccatgcgtttgcatgttatgacggtgaaatcggagacctgctcaagcaaaagtgtgaagaggttggcgtccatgtccttacattctctgacgcaggtttttccaactttatcaccggagatactccgattaccgttcccgatgatgcaaagggtctcaatattcgcgttatggaaagccccggcctgatggcgtacatgagcgcgattggcgcaaatccggttccaatgggtatgagcgaggtgtttacctccctgcagaacgggacactggatggcggcacctggccgatcgtagtatcttacaacaaccagtattatacagttattgattatctgacttatgtcgatgccgtggccacttctatccagacttccatcagcaaatctgtttgggatgctctgcctgaggagtatcaggaaatcattacccaagcttccaaagaggccgtcgagcatcagcgccagttgctcctcgataatacggatgctctgctgaaagagatcgaggcaagcggcgtcaccattatcaatgccgaccgtaaattgtggaaagaaacagtttttgattattgcctggacgccatggttccccagtatgtttctcaggaactggtcgatatgatcaatgctcagaaataacggtttttccgtgaaacgccgcctttgcctgaagttttgcttatcgcatcgcccagtaaaggcggcagttcatctttaccaggaggtaaaaaatgcaacaaaataagaaaagctttgtcaaaatacttgatggatatctggataaagtggaaataacgattgacataatcgcctttctgggaatgacattcacggttctgatctccattatacttcgctatgtagtgagagtccccaatttggttggcgaagaaatttcccgctatttcctggtgacggtggtttttatcgggattagtatgtgtatgcgtgtaaagggccatatgggcgtgaccatttttgtggaccatctgccttccaggattcaagccgtagtaagatgctttgccgatctggtttcgactgcaacaatttttgggataagttattttgcgtggaagtatgctcttgcggcggtggaacatccgcagataagcgttgcgaccggtttgccgatgtatgtgatgtacgctgtgatggctttgggctttactctctcggcaatccgccttcttatattattttggaatgatcacctttccataacgcatccgctgagtgaaaaagagggagggaatggataaatgatgatcgccgtgatctttggcacgtttttgctggcgcttctgatcggatgcccaattggtattgcccttttgctgggcggcggtattcctattttaacgatgacgaatctggatagcgccattatcgttcagcgcctgttttccgcggcaaacaactattctctcatggcggttcctttctttattctttccgggagcctgatggatgtcggcggcgtttccaaacgcctcgtaaattttgcccggtcgcttgtcggatggctgccaggcggtttggccgtcgtgtccttcctggcctgcgcattttttggtgcgatcaccgggtcggcgccagccaccgttgcggcaattggctcgatcatgattcccgcaatgaaagaagacggatacccattgccgtttatccttgcgacagtcgcaagcggcggctggctgggggttatcgttcccccgagtatccctatggttgtttacggggtttccgttggaaccgtatccatttccgaattgtttctgggcgggattattccaggctttttgctggcaggaggaatgtcggtatatgcggtcctctggggcaggaagaatatgccccatgcaacgaaaaagttttcccttcgcgaagtatggacttcttttaaggaagccctctgggcgcttgggatgcctttaatcatcttaggcggcatttacgccggtatctttactgctaccgaagctgctgttgtctcagttatttatggcctgctggtcagcaccctggtctatcaccagttgacgctcagggggctggttgggatgatgcgaaaatctattattacaacaaacgtatgtatgtttattgttttaacatctactgtttttgctgcgattatgacccgtgaacagatccctgtgatcgtaagcaatgcaatcatgagcgtggcaaagacgccgtttatgttctttgtacttgttattctccttttgttatttgttgggacctttatggaaacgcttcccgccattatgatcctggcgccgattttgatcccgatgctttcaaactataacattaactctgtttccttcggtgttattatgatcattacactggggatcgggatgttgactcctcctgtggggatcaatctgtttacatctgccagcctttgcggtgaaaaggtggaaacggtgatcaatcgtcacctgtttgcctatatcggatgcgcacttgcggtgcttgttcttttgatcgtatttgatgagattatcatgcttcttcccaatattgtaagagcgagaggataacattcagtttccccgcgtattcgatgcgtttctttgcagatgtaccatctggccgccatggcaaacaggagtcaggtcgctgaatggctcacgaacggtaaagccaggtgatatagcaatttcaaccgattgccataagtggcaagagcctggagccaatttgcgctccaggcctcctatatccaaagagctacccgtgtccggggtggttccaaactgggcaggcttgtcaaaagagagccagacgaacactgtgccagtcgtttacatgcttggcggagtgttcgttttggtttatccatttacaatttaaaaaaataaaaaagtctattatacagtaaaaatctgtataatagactttttttacataacaagttgacatctaggggactttttgatagaacaaaccaagaaaggggcgaaacagatggataacgtgatcttaaaatccttatctgccgaaaatttcgcttcgtttgccgaacgaattgagttttcaatggagacagattcaggtaaaaaggagcaccttgaaaatacattcacagtagaggatatgcgtttcaacaaggtctcttttctttacggagcaaacggatcgggaaaaaccttcttttgtaagattttgagggaaatccagcggattttagctctctcccctctaattacggcaaccaatagcgatcgtttccttgcaacgccgcagatgaaaggcatggatgctcctataaaatcttttgcctttgacacgcaatatcaagacaagccgacaactttaggaattgatattgttttaaatgggataaattatcattatgagttctcgattcaagggaaaacagttgtacgagaaattctaacaaaaaaattccgccggacagagaaacttatagaacgtacatcttcttctttcaaagatattttgcttcgttctgatttgaaagggtttgaaccaacaaagcaaacagtaaaacctgaagctctttgccttcctgttgcagcaatgctgaataatcctttagcggctcaactcaatgcagcaatttgtggcattcaagtcgttagcatggctgcagggcgtttaaacccaatcaatcccaaaaagacctttaccgaagaacgcatagcaaagtacatacgcattatccaaaaagctgaccccacgattcgaaatatcagcgtatcaacttcagaagaagaaattgcacggcaaaaaattgatacggatgattttgaaaatagggagatcattgcaaagaaaatgacggtgagtgttgataccaaacacgctgtttacaataatggcgaagaacaagatagtcaagttccaatcactttcttcgcagaggaatcactaggaaccataaagctatttacggctcttccgtatctctatgacgtcttggagatgggcggcgtccttattatcgacgaattagagaatgggctacatctctcacttgcaaaggaaatcattagcctatttagtagcgaagaaagcaaccccaaccacgcacagcttatatgcacttcacatcaacctttgctgctggacggagattaccggcgcgatcaagtttgggtagcgatcaaagattctgttggaaaaagctcattacatagattgagtaaattaccgacgccacgagccaaagtaaaccttacagcacaaattttgaaaggggcttttgggtgtaatccccaactgttctttgacagcaacacataataagaaaaaggaaagacaccgagttgcagctcggtgtccctgcgggatgacagaagcacggaacgtagtactttgtcatataccttatttattgtaccacgcttgatttccgattgcaatatgaaatctgtgtccagaaaggaaaataaacgcagtctttttcctaaaatgtgatgatataaatattacattttaaggagatgatagtcatttttatttctgactacctcggcgctaagatgaaagggcacaaaaactacgagtttgttgacgcttttttaaacggtgacaaccgactttttattgatccatgtatgatagaaagggcagaggatccatggtctataaatgccgccaatacaatgcgagtattttttgattgcctttttgaaggtcttcgggagagaacgctttataccagtgggctgctttctcatgctggtgaacaaaacgcgactaagcttggctacggaaatggatggatccaagtgtctcgaccgtgttggtaccacaacggcaaggaattgcttcttgtacctaagtggattgttcgcaagaattttcttttcaaagctcatcaatatctgtattcagttatcattgagcgcattaaaaaagccaacggatgggatgatcttaaaaaggtggatatttggaacaatcttccccgaattagtgagcattgggagtatgataccgtgatagcttatacccgtgaacatcccgaagctctttcagagtatcataatcatatgccgcgattttatcgtagagcaaggggctgtatgacagatgcggatttggatcttgtggtttatggtcgcagaactcgagagagcgcataatcagcatcattatttaaagatggagacaaggtgataaaccttgtctccatctttgctttgctcactcctgtgctgcttgccgttcttcaaactttcgctgaccttgctcgctgttatataaacttcgcaatcaggtggagagactcttttgtcgtctcaagagatttcgtagaatctatatccgctacgacaaactggatatcgttttcctggcctttgtttacttagctctcgctgttgattcccttatgcgaacacaaccggctcttgggtgttccgttgatgttcgcttcactttacctgatggagaggaaatataaaaaaggcccgaacgcttgaatgtccgggccgatggagactggctcattttttagtatgtaggggtgtgccggttcgtctcttgactttgacctcgttatttggctcgcgaacaatgagatctgatagctcgcaatcaagtgcttcgcagattaagtcgagatgttcaaggctgacccgttcggcaaactcgtgatagagttctccaatcgtgttaggtatgattccggtagcctttgcaagatctgcctgcgtccacctctgctcgccaagccgtgtggacagtaaaatcctaatcatagccaagctcctttttattagattctaacaattattttagaatcttgcgggtctttggtaggaaacaacaattctcgctatagtattttatgtaaaaaatcaagccgaaacctgatcatcccttgaaaacactgtatccacgggcatttcagacaggtcaaaaccacctcatttactacgattttactactgttgagtgagccttgacacgctgaaagaccacgaaatgccaagatacggatacagcacctgtcaatcggggcctccgccccgtgaccatataactgaatacagaccggccatctgccggggcaacgccatgggtaacacaaacctgtggcgtttttttatgccctgccgggggcacgcaaaactgtatgaaaacgggtgggaaatcccctgttttttcgcctgtggacggcgcaagcgaagccacccatatccttttcctcatgggggccgggcggtgatacgggggcgcaaacccgccgaaacgaacacttttcaaaaccaaaggaaggaggtatccaacatggcggtattccgcattgagaaaacccgcgattacacggtgatgtccaaccatcatctgcgggacaagtcgctctcgctgaaagtgaagggacttctctccctcatgctctccctgccggaggagtgggactataccaccaaggggctggcctggatctgcaaagatggcgttgacagtatctgcgccggggtgcgggagctggaggaacacgggtatgtgatccgccagcgggtccgcaaccccaacggccagctcggcgccatcgagtacaccatcctggagcagcccagaccgccggaaccaaaaccggaaaaacctgaacgggaaaatccagtcttggataatcctgaacaggcttcccctgtcttggaaggacctgaacaggaaacccccgcacaattaaatactaatagatcaagtaaagagaaatcaaaaaaagatctatcaagtacggaaggatcaaatcctatcccatcaagcccccaaacccccgcagggggcggacggatcggacaggattggatgcgggaacgggagaactaccgggaattgattttggagaacatcgagtatgactacctcatccgaaaccatccacttgaccgggaccgtttggatgaactggtggacacggtatgctcccaccgggagaccatccgcattgccggagatgattacccggcggaggtggtcaaatcccggttcctgaagctgaacagctcccacatcgagtatgtgctggaccggatgcgggagaacaccacctatgtccgcaatatcaagaaatacctgctggccgctttgtataacgccccggccaccatcgacagctactacacttccctggtgagccacgatatgtacggcgaacatggagatgccagccaccagtcataaaggggtttccaaattggaagctcccctaagtgtagagaaccgggatggaacgaaacagtccatcccattacaacgaacatccgccatcaacaatgggtgccctaaaacggggctccctgcggctgtgcaaatacgggatagagcatgggcgaaaggcagaggatcacaggcccctacaagcaaaactttctggcggtgctcatcgcttgtcctcgttgccagtccgcacgctcgataaagtgtgcagataggggttgaaaatgggctgaaaaatcgcctgtgacggcttctccgagagctgcccttatgatttcccatgtgggtctgccctttcaatttaaggggtgcagagaggctgttttgaacacttttccataacagagcgggagcgccgccttcggtttgagttgggggtgacgctcccattatttttttaaatttattctctaatagcgaaatttcatgttgacatacggctcaaaatttgctattataacattgcagcgaaaagcagagcaggtgctctgctggtcttctcccccaaattggagtgcgtcggcactcgcggaacatcttgaaggtgttctaccccacgggggcggcacacggcttgaccgcccgatgcgccgtcgcccggcatggcccaagccgggtgcttgggccatgcccaaagaaattagatgggttgtcctgtatgcaccaactctttcccgggtgggggtcacatcaactatatttcgtgaccctcgaaagaggtatactatgaacaagtataaaaaatcgctgttcatgcaggacagtcccggcaactcgtcgaacccccgaacttctcaccgtttcaagttcaagcgcaaatggcgcaaagccttatttcggttggcgtttagagcacttgaagttctgctggtgattttacaaatcatccagtgcttttgtgagatgtttaagaagtaagacgaggtggtgcagcaaacgggaagcccatctaaatttcgtttattaggccaaacggcttgtattataaatcgggcgcggagtaactgggaggtgacaggtatgattggagatgtgctgaaacgtacacgcatcatttatggatataaggctagtgaaatgagctcggaacttggcatctctgcgagttacctttcggaaattgaaaacaacaaaaagcagccttctttagaattactccagaaatatgcagatatttatggtatccgattgtcctctttgatattactttccgaaaatatggatgaagcggaaaaatcaggtaaaggaaccgcctttatcagaaatatgatgatacacctgatacagagtatgtctgcaccggcaggtgattcaaatgaagaataaagctcctctcaaaaaatatgacatcactcaatgtgctctttataaatgccggacaaaaaagcgtcttgagtatctcctgcgtcttgaccccggtggcctcaaaatgattgatgacatcatcgggtatcacaaattcgaaatagataaaaagcactctgatgaaaaaagagaaataactgccccggataagacgcttaaagctatccaacgcagaattctttatctgcttcagcgggttatccggcctgaatggcttatttctggagaaaaacggaagtgctatatagacaacgggaaggcgcatttgaacgggaagtatgcgctgactattgatattaaaaagttctatgacaactgtgcacgagaacctgtataccagttttttgtgcaaaaattgaacacttcccctgatgtagctgagatcttaacgaacattataacatataatggtggtatcccaaccgggtgtccgacaagtcaaattatggccttttacgcctattccgatatgttttcagaaatctttgatttggcgaaacagcacggttgcaaattcactttgtatgtggatgatatgacattttctagtaaagagcctttttctcctcatcagttgagccaaatgattgaccgtgttctgagaaagtatgggcacaagcctaaataccccaaagtaaagtattatggtccatctgactataaaccaatcaccggaacagttgtcactcccgaacattcccttgccgttcctaatgggcttcaaaagaccatatacgatacatttcagactgtaaaaccactgattgaagttgaaacctgctcggaagaagatgcaaggcaaattctttcattaaaaggacagatacaggccgcctgtaacattgaagatggaaagtttcctgagattagacggttaacgaaccaaatcaaggttccagatagtcagtctgtatcaacgcgaaaaagacagcaccacagacgtagtaagaaaatccatataaaacagcaagcaccgactaagtaatgtggcgggagcgtcgccttcggtttgggccgagggtgatgctcccgtttcttttttgctctctttttttctttcaatcaggattggacaggaaggatattcgcagcagcaggcgctatgggaatgtgtgtaaacggccatgtctgcggagctgtgggaaagccgacggcttttccatcgggccgtgaatgactgttttccatcggtggagcgaccgttttccacatttccatagcgctttcgtgtctccctctttgataagggtctgggactatcccagcaagccattttgatgtttaggggcaggggtccccctaaacgcaaaatccgcaagtgtggctacacttgctgtgcttgctatcaagacttttcccctcgttttcttcctactaatactacaatttgaaacggagattttggctgactatactgaattggagtgctataaggaatgggctaatttcttgaattgtgctcatacttgtgttatcataatgatgagtaagttgagactaatcgaatggagggatatgcgtggacaaacccaactttaatcaagattggtacggtatgcaggccaaagtattatcacagaatgacgattgtgtggtcgttgattatggttgtaatggccgtggaattgtaaaaaattataatctattcgagggaatacagttttgtttccttgattttgaaacagatgaggctatgaaagctcaaaagttcaatccagatattatccagattacgcattgtcaaactggacgctatgaatgtgaattttccaatcatacggtttcgtatttgccagagggctattttagtgttgcagtaacggagcatttgccggtttctttttcttttcccttgagaaagtattacggtgtaagtcttgttatagatcgtcaagcattgtcagatggagcacgccggatgatacagtcaattcctatcgaccttgataagataggaaaaacattaaaaattgaaacacgatggtatgtcagtgatactccaccgcagttacagtatcttttttcggaattatattctgctgttgaaacggagtcgattggttatttcaaaattaaagctatcgaattgttgtatcatatagatcagttgacgcaggttaacgggtgcgatttaatgtattttgataagaaacagatacaagccacaaaaacaattcgggaatatcttgtttcgcatttggataagaagataccacttgagcagttggcaaaagaagtacatttgaacctgtcggtgtttcatctggtattttctcacatctacggggatactccgtatgcgtatctcaaaaaatataaaatgaatttggcagctcagtggctttcagagaacaagatgaagataggagatattgccttagagctgggatatagtaacgcaagtaaatttgccaaagcgtttcaatccgtatatgggatgttgccaaaggactaccgaaaaatggatggtcaccgttaatttgttggtatatttgggctattttagagctcataaaagagatatggagtagcagacactttcaaagattgatagaatgaatggcgaggttagaaaatgctaacctcgccattttcaattttaaggagggttcatgctatgtcaaacacaaagtcgaaacaggcaaaaccaaagacgggtttggcgcgatgcatggaattagcttctgacagaaagggccttgttttcttggccgcagttctttcgtcattggcggccattgcttcgttcattccgtacatagcggtctattttatgattcgctcgattatcggtgttttcccgaaccttgaccagttggatatggggatagttatgaattacggctggctggcgcttgccgggatcgtggcaaatatcctactgtattttctggctattttcagttcgcacatggcggcgtttgggacattatacgagttgaaggttctctttgcggatcatattacaaaaatcccattggggtatcacctgacgattggtagcggtcgtctacgcaagatcatggatgaaaacattgaaagtgtggagggctttattgctcaccagttccctgattttgttgcttctatcacagcgcctatcgtcatggtcatcatcctgctggctgttgactggcgttttggtcttgcttccctggttggtatcattcttgcatttgttgcagagtttattggttttggcagcggtgaaatgaaagagaacatgggcaagtatcaaaaggctctggaagaaatgaataatgcctctgtggagtatgtccggggaatgtcggtggtaaaggcgttcaatcaaacggcatcttcgttcaaaaaactcaaagaggcaatcaccggctatacagaatgggttctcaagttctccttgggttggcagaattgtatgcctgcttttaccacgatcatcaataatgtttacttgatccttgtcccagtaggcatcctgataggctccagaacggatgattttgccggatttgcgatgacctttatcttctatctgctttttgtaccggcaatttccggcgtgctgaacaaaattatgtatatttccgagtcgttcatgcaaatcgacgggaacgtggctcggatggacgagattttgaacattcccgaaatgccaaaaacagctcaccctaagaagcctacaaaggatgatgttgttttccacgatgtcagcttttcctacacaggggatacttctgagaaagccctggaaaatgtatctttcgcagcaaagcagggacagattactgcaatcgtcggcccctccggtggcggcaagagtacgattgccaatctgatttcccgtttttgggatgtgtccgttggcagcattactattggcggcgtagatgtgcgtgatatggcagaggatgatttgatgcgtcatgtcagctttgtgttccaggatatttttctgtttaagcaaagtatcttggacaatatccgcatgggaaatcctggggctagtgaggaacaggtgattacagcagcgaaagcggctcaatgccacgagtttatctccaaactgccggatgggtatcacacggtggtcggttccaaaggcatccatctctctggtggcgagcgccaacggattgctattgcgcgggccattattaaagactcgcctatcatcgtgctggatgaggccacggcgttcagcgacccggagaatgaatatctgattcagaaagcctttgaaaagctgatgcagtgtaagacggttattatcatcgcacaccgtctctccacgattcgcaatgcggataagatcattgtcatggagaaaggacacttggttgaagaaggaaaacatgacgagttggtggccgcaggcggacgctatgcacagatgtggaatcactatacagaagcgattggctggaaaatcagcggaaaggcggtgtaactatgagcagattgcaaaaagctctctttttatcagacaagggttacgcagatttgaaaaaagcaatcttcgcctgcacattgacgaacctcgctatgcttctgccgttctgtgtaactgttatgatttttagtgaaattctgacgccatttgtcagcggtggttccatccagtggaaccatatatggatgctatggggcgcgggtattgtttcagccatactggtatttctggccgccaaaaacgattaccgcaaaacctatattgcctcgtataaggagtcgaacacgacccggctgcgcattgcggagcaccttcggaaactccctatgaatttctttaacaccaaagacctttccgaactgaccacgaatatgatggcagattgcagcagcatggagtctctgctcagcagcacgatcccgccactgattgcaaacggcatcacggtgaccctgacctgtatcctgctggccttctttgactggcggcttgcgctgtgcgtattcatcacggttccgattgccttcctcattatctggctcagccggaaccatcaaaagaagctgtttgaaaagcaggttgatgcaaaactggctgcctctgaccaggtacaggaatacctggaaggtatgaagatcatcaagtcctgcgggctgtctggttctcatttcagcgcgttggataaagctctgctggcaatgaaaaaaatcgccattaaagtggaaatggctgtcggcgtgtttatgtccagcgccagcatgattttgcaggcaggtattggcattacaatctttgtcggtgctatcctcctgaccggcggacaaattgaactgctgcctttgctcatgttcctgctgatggtcacgcggatttatggtcctattttggcaatcctggcgaatttgtcctcactgctgaatttgaatgtggtcacaagccgtatgcgcacactgttaaccactcctgcaatgaacggcaacgagaaaacggtcccgaactgcgatattgagctttcccatgtgacctttgcctacaatcaggaagatgtcatcaaagaggtttcctgcaaaatcccccagggaagcgtaactgctctcgttggcccgtctgggtccggtaaaagcacgatttccaaactgattgcccgcttttgggatattcagcagggcaagatcaccgtgggcggcaaggacatcaagagtatggagccggaaagcctcatgtcttatatgtccttcgtgttccaggatgtgaccctgttcaatgatacggttatgaacaatattcgtcttggtaatccaaacgcaacggacgatcaagtgattgttgcggccaaagccgcttattgtgatgagtttgtccgggagatgccggacgggtatcagacggttctcggtgaaaacggcagtacactttccggaggtgagcgccagcgtatttccatcgcccgcgctttgctaaaaaatgcgcccatcattctgcttgacgaagcaacagcatcccttgacccggagaatgaagtcctgattcaaaaggcgattgccaaactggtggaaggtaaaacagttattatgatcgcccaccgcctccgtacagttgtggacgcagaccagatcctcgttcttgaaaatggccgcctggtagagcatggaacccacgatgagctgatgaagaagaacggtctgtatcataagctgttccatattcagcaggagagccttggctgggctgtgtaaatcgaagctgaaggaggagcatagttgaacggagtagagttgcttttgattgcagtcggtcttgcgatggatgcttttgctgtttctgtgggcaaagggctagccattcaaggacaatgtaaaaaagcgtgtattgtaactggcctgtattttggtggatttcagtcgattatgcccctcctcggtttcctatgtggagagagttttattcagtatattgcgcctatttctcgtgtgttgtcgttcattctgctggtactgattgggctgaatatgttaagggaaactcggaaagaaaattcggaaatagatacagcctcaatctctccagcggcaatgattccggctgccattgcaacgagcattgacgcatttgccgtaggtgtcacttttgccgcattgaaagtaaatgtattgtttgccattttgttaatcggttgtactgcatttttgttttcgagtgcaggtgtcaaaatcggaaatatttttggcgaccgtatggaaaaacaagcaggaatattaggtggatttattcttgttacaatcggtgtgaagatactcgttgccggataagaggtaaaaatgaaactttatgcgtcgggagaagattatctggagactatacttattctcaataaaaagatgggcatggtacgctccgtggatgttgcccggcacatgggagtatcaaagcccagcgtatgtgtagcggttaataccttgaaagacggtggttttctcacgatggatgaagatcacttccttcacttgactgctctcggctggaaggttgcagagcaaacctatgaaaaacatctctttttcacaaatcttctcactgaagttggcgtagatgaaaaaaacagccgagcaggatgcttgccggatggaacatgtcatcagcgaggagtcctttcagaagctaaagaaacaagtttgttcaatgcggaaaaacgcagaggacatagatacatagagagggtcactatgggttacttccccttttgaataccctcctggagaaggaggacgactaaagagaataccactgccttctgatggggcgcggacagtcattgaactgttcgcgccccattttcattcgacggcgttcctgtgcatttgctggcgtgttttaacgagtacagaggaacgccgtcgagttttcagagcagattttttctgcaaaacccggattgcggttgattttgaaaaaatcagcgatttccacaagaaagaggctggattttgtccaggctgccgctcgcctccttcgtttcgttccgacccatcgaccagaacgaaacgaaaagagcttaactatgagcggtaaatatttttttagaaatcttaaaaacaattatgcggacaagacaaacggtccctttgatgaacgagtagtaggcgaaaggggaagaaaagacttgcctcctggcacggagggaggtgagaatttgaaatctgaccgccactacgagcataaacagcacacctttgacagctactgcaagaaggtgttgaagtgcgaggcgtacaacggctatcgcgagatcagccggcgtcagaagcgcgagatactgttctgtgagctgccggaggaaacgatggcccaacttgcggcctatgaccgttatccctgggagtacacttccttccccgtaggtggtgaagtgatcctgatagaggatgaccggctggctgaggcgctgaccgccctgcccccggagaatagggacatccttctgatgtactggtttctggaaatggcagaccgcgagatcgccgagtatctgcacatggcccgccggacagtcaatacccgcaggcagaaagcctatcggctgctgaaggagctgatgggaggtgaagcggatgactaaatctgcgtgcacgcgggcggcattgctcccttatccggtgatcgctgccgctgtcgggggcgaccccgacgcggtggaccggatcgtccggcactattccggctacatagccgcgctgtctatgaggacaagctatgacgaaaacggctttccccattcccaggtggatgaagatctgcgtcggcggctggaaacaaagctgattattgcgatcctcggttttaacctgaactgacccagggccgggcgctgcgtgtttccccctttccacgcggcgccttttgggaccttgacaaagaaagccccagggcagcataaggcagacggatacgatctgtctgcgttgagccggtcggccggtgcgccatgatgccgtttcaacccctgcggggtggcgacggaggagcgacagacaccaggccgtaaaacaggtatggcagcctgtgggcgaggatgtacagacaggataatgatactcccgcgttgaacgccctcaaagcattgcgcggcgcacccatcagcatgggccggggtgaaattcccgtggagctgcggccggcagccgtccagtttctgcctctgatctttacagcaccgtcctctcgaaaggggacgcgcaaatttttaggaggtgttgtatttgaacacgaacgacatacctgtttggcaaaaatatacgctctccattgaggaggcgtccaaatattttcgtattggggagaagaaattccgaaagttagccgaggaaaaccctgacgccaactggctcattatgaatgggaaccgccttcaaatcaaacgccgccagtttgaaaaagtcatcgactcgctggaggttatctgatgaagcggctgacaatgggccaaaggcgcggtataatatggttaagcgtatcgaggctcattccagcgatggaagggagctttacatcatgtcagagaaaagacgagatagcaaaggtcgaattttaaggactggagagagccagagaaaagacggaagatacgcctacaaatacatggatgcctacggaaagcctcaatttgtgtacgcatggaaattggtctctactgaccggacccccgcgggtaagcgtgacgacatctcgctccgcgagaaggtgaaggaaatccagagggaccttgacgacgggatcgacactatcggcaagaagatgacggtctgccagctttacgccaagcagatcagccatcggaagaatgtcaagcggaacacggagaagggccgggaccacctgatgtctgttctgaaagaggacccactggggtcgcggagcattgacagtgtgaagctgtcggacgcaaaagaatgggctatcaggatgaatgaaaagggctatgcctacaagaccatcaacaactggaaacggtctttgaaggctgccttctacacggcaatcgaggatgactgtatccgaaagaacccgttcaacttcgccatggacacggtcctgaaggacgatacggaggagaaagccgcgctgacgcaggaacaggaggacagcctcctggccttcgccagcggcgacccggtctaccggaagtattgcgatgagatcatcatccttttgggaaccggcctccgtatctccgaactgtgcggtctgacggtcgatctggattttgagaatcggaggatcgatgtggaccatcagcttttgagggacagcaagctcggatactatgttgatgtgcccaagaccaaaaatggtatgcggcaaatccccatgagtgataaggtctacgaggcattgaaacgggctgtgaggaacagaggcaaggctgccccggtcaatatcggaggctacaccaatttccttttcctcaatcagagcggtctccccaaaacggcgtcctgttatgagagtatgctccaggggctggtcaggaaatacaacaagcagcataagccggatgaagccctgccgaacatcacgccccatacgatgcggcatactttctgcacccgtttagcccacgctggaatgaaccccaaagacctgcaatacatcatgggccattccaacatcaccatgacgctgaactattacgcccatgcgacattcgcttctgcgaaggccgcgatggacaaactggcggcttgacagtacaccgtttctactacggttttactacttttggacgccaagtgaggctctgaaatgccgggttatgcggggtatcttcccaaacgcaaaatgccggaaatgcttgatattccaagcaattccggctattgcgaacatttgaaaagataatcagaaaatcggtagaatttttttcaaaaaagcgggggcgcagccggctaaagttttttgccgagcttttgacataaaaatttcgttcaacaagtcgatatattggttttaaataattttaccgctgattttgccgaaaaatgagaattaaggtaaaacttcgatccttattttgcagacatcacagccacacctttacggcaaagcaatctttgaaaaagattgaaaatgatgtaatatttatataaatacacaaaggccccacaacaggactgatcctgccgcggggcctttgttataaattttgatggggttatgccttgtcagcatccaataaccttgtgaccaacgagagcgccgccgctaggttatcccgcagcccttccaactccgcctttgaagtggagatcatttcatcctttggcttgtccggcgtatccggcttatcctcacacttccagccgttgagcaggtttgcccggatgatctccggataatcccggtagcaggcattgatatccaccggtacggaaataccggccacgcgccccacaaaacccggcgcgtccccatgatgctgccacatcccaaagctgccggtataggtgcatttttcggcgtattgcgcaacccacttgtcatatgcttcaagctgtctcgggtctacccagttttgcagccagtcgatcgaggcgtacagtcccgcgtagtacccggcatcctccagaacattcaggaatgcctttgccatatcggtgcgaagctgctttcccttgcccacgccccaggcgttgccgcagggagattcgtattcctggtccatgtacaccggataggtcgggcgcaggccgtcgagcgccctgacgaatgccgccgcctccttttgagcttcggcgaccgtcacggcgtcgctccaccaatatgcgccccagtcaaggccagcggccagcactgcgggcggatacttctgacgaaacgtccccatctcccgaaggccctgcccggccttaatgatcacaaagcggacgccgtctgccttcacacgctcaaaatcaatgtccccctgatgcgacgaaatatcgatacctttaatctccatagttatgaccattcctttccgctgcgcttcaaggcaccaaaggatatgaaacacggagcctctaacgcagcaagtcgtaatttgttagaatgtacttgggggagcaggtacactacagagcatgtggagttgagtaggctcagcacagtgctggactgaatagttatgtgtgccggacgctctttcaagcaccaatgagtagagcttcgtaccctgtaaccttatctttggagagacagactgcttcaatcttttagtgagtgtccagtccctgcctgctccctcaaatactgtttcgaggggatgtgttatgctcaaaatcgtttaccgtgtctgctgcgggatagatgttcacaagtcctttgtcgttgcctgcattgcttctaccaatgagcagggcgtaacgacctacaagagcaagcggttttccacctttaccggagatttgcggcggtgtgcagtttggctggctgaaaatgactgcaaggatgtatgtatggaatccaccgggaagtactggttccctatttacaacatcttagaacccacttgcagcatcgtcttggctcatcccaagtatgtgaaagcaattcgaggcaagaagaccgacaaacgggatgccaagtggattgccgacatcttcaagcacgaccttgtcgccgggagttttattcctccggcagatattcgccagcttcgggatttagtgcgttatcgctggaaactcaccaacgttacaaccggcgagaaaaaccgggcgcacaactgtctgacggtctccaacttcaaactggatgatgtgttttcagatgtgtttggcaaagcagcttctgcaatcactgtccgcattctggaaaatccaaagggaaaaattacggatgtttccggtttccgaaccaaaggcatgaaagcgaccaatgaacaggtgctcgccgctgtagacggagagatgtgtgacgaacaggctgaaaagctccgcatcatccgttctcacatggacagtctggatctgtgtaagctcaatctggaatcgctgattctgtctaccgccgagaaatacctcccacagctcaaccttgttacgacggcgccgggtatccaatcctttgccgctatcggcattatctctgaaatcggagtggatatgtccgtgtttccctcctcaaagcatctttgctcctgggctggccttacgccacagaacaatgagagcgccgggaaaaagaaaaccaccagaatcagccgggccggagcctacatcaagccgctgctcgttcagtgtgccctcaatgctatccgcgccaagcaattcccagaagttcgtaatcgctatctcgctctcaaaaagcgtcgaggccacaagaaagccatcatcgccattgccagaatgctgctcaccgccatttataacatgctcaagaaaaatgagccttacaattctggactctaccggcaggcagaccggccacctgcacaccgtgaggtttctgtggatgaagctgtcttcattctccagcggcagggctatctggtgactgcgccaccaacaccttagactcttataataactttttccgcccgcttttagagggcttagttttgtgtgctctttttcagaatggtgtttagattactttgtttcaacctttattactcccttctgcataaaaaaccgctgatcgtttccgatcagcggtttaatcccaaaatgtccgcgcaccgcctttggatgaaaagcggcgcttctggacgcgcgatatatttcaatcatgcggccatagaccagcacgaaaataatgatattcagcgcccacatggtaacgccgataatggaggactggagccacaggcccaacagcggccctaaatccataccctccagcgtcgtttcaagctgggtcagcatatccggcgtaatgtccgtggaaccctggatcagccccgccgattgtgcaatcacgctctgggacacgtcaaacacggccattacgatattgaatgtgtttgacagaataaggatggcacaggacgttttgaacatccatttgtagatattcgccacatcaaactcgtgcatattgtttttttccaaaagcatctggatcagttcataggtcgcaacaaaggtcagcaccattccggcaatcggcaaaattaccgtttcggaaagctggcggatcagggagaacaccccggcgtgccatgccgccggggttgttcccacttgtaccgcaatctctccgacttgggcgtttacgttatcaaagagccccgaaaggttccccatgatcccgctgattaaaagctccttgagccaatccgtgagccagtcggtgagaaaatccataagccgctaccttaaaacaggccagagagcagggggatcagcgttgtgcccagcaggatgatgccgccgcccgccatgagctgttttatccccaattaggtgtaaaactctgctcgatggcgggcggcggcgtacaaaaaatctatatggtatttttaagagaaccgtcctggcgggacaggtcaggcagtgacctgttccacctccgggatgggtttgagattaaaatgaatttcgatagaaatgtgtcttgttttatcttcgtcaatgcgctcatgcacgacgatttctttgattaagcggttaagggtggctgcgtccagctctgtgatgttggcgtattcctgaatggcttccacccattgttttgcatcattggcaagctggacttcatcggacagccgctttctgccctcggacacttttgttttaagctccgtctgctcggtctgtgtcttttccagcatggtgttgaaattctgttcactgatacgccctgcaatcatatcctcataaagccgcatgaccattttgtccagaacctcaatccgttcctcgtcccttgtaagggagcgttccattgcttcccgctgttcccgctgctctgcttcacaggtattggtcaggcggtcggcaaccgcttccccgtccatcagggcagctctggcacattcccggattttccgcagcacatggctgtaaagggtgtcatagtcaatccgatgctgggtgcagtggttctttccaaaggcattgtaggtcttgcaggaataaatctgctggggatgttttgcgtttgtgtagcgtatcgtcagcgacttcccacactcgccgcattttatcagtccagcaaacaggctgatttcattggtctgccccggacgctggcgggatttcagcttgttctgcacaatgtcaaagctcatgcggtcaatcagcggttcatgctgtccctccactacaatccagtcctccggcttcttttccccaatcgtgccgattttgaaacggtagtcttttttctgggaagcaatcgccccggtgtagacgggattcatcaaaaggtctttgataacggagaagtcccacatataccgcccgttttccgggtctttcttttcccattttgtgcgggtgttgcgaagcccccgttcccggttccaccatgtggggcaggggattttttcttcctccagccgtctgcggatatagttcggaccatgaccgttcagggcatatccgaaaatcagccgcacaatcggggctgtttcctcgtcaatgagcagatggttcttgtcctccgggtctttccgatacccaaacggggcaagacacccggtaaactgtcctttctgcgctttcagaagataagaggaatggactttcttggaaatatccttgctgtacatctcgttcaggatattcttgaacggggcaatatcgttgttatcccgcagggtgtcgataccgtcattcatggcgatatagcggacaccgtttcttgggaaaaagtcctcaatcaaatgcccggtttgcagatagttccgccccagtcggctgaggtctttcgtgatgacaaggttgacctgcctgcgctcaatggctctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgatagcccccggcaagtgccgaaccgattgttctgtattccatttcgttcatcatagccatttacccacacaatccagacggtatctggctcttttgaacctcatcttcattatacttcatatctttctttttagcaagatattcttttgcatttgtctttccgtatttctgggaaatcaggctgacgaatacatcggttgcgtccagttccccgtcaaacaccgtagtcacatgaatctctgttttgttttttgccataggcagttatcctccatacatgaaaatagccagacagagggtgtcggcaacgaagtccggcaacgggcttcaaaagaccttgcaaacaatctcaatctggcgatggttactatttatacttttcttttatttttctgttgttttggttgtcataggggagaaaagcccggaaataaggggttttccccggcaaccggctcggcaacgggatagcaacagggggtgcaacgggctgtcattttcagaatggaagctccatctgttctgtgacctccacaaagccatccattgctttttcagacgggttgcataagtccgttgccgggttttcacgctcccagcccttttgtctgccgtattcggaaaacattcttggattcgggaagtaccgccagcggtcaatgcattggttcataatctcgttgatttcccggatttcccattgcttcggctcgtcaaaggcatggttcaaagcttccttgtagagctgcttggagcagaccatgctcccggtgtacctatcaagatacgcctgtatcattccggctttggtgtcctccggcataaaatcccgctggtgttctttgagataccgctgcatgtcggggctgaaagccagcttgaacctgccgcttcggtaaatctccatcgcttccgcccacatctgctcgatataggctctggaagcagcttcgtcctccaaaatgtgaacctcggcttgctccgggtacaccatgacggggataaagcggcggttgccggaacggtcaaggggaagaaaatcaagggcattggaagtgccgccaaacacgcactgacgggggcggtctgccgggtgggtttcatagggtatcttgtaaacctctttctgccggcttaaaaatgacttgatttcctcaatgctcttggcgttggcggttgccatcatttccgacatttcgataatccagtgaccttgcagcttgcggtacacattgtcatcgtccaacttccgcaaatcatcggagaaccactcgtcccggactgccagcagacggaagaaggtggacttgccagccccctgaccgcctaccagacagagcatgatttcaaatttgcatcccggctgaaaggctcgtgagattgcacccagcaggaacagcttcaacgcttcataggtgtaatcgtctgcgtcagcccccagaaagtgccgcaggcagaaacggattcgctctgtcccgtcccacacaagtgtattgagatagtcccggatgggatggtacttgttttcattcgccacaatcccgatggcgttatcaatcttcttctcattggtaagcccgtaggtttcttccagatagagaagcagatacttcatgtccgtatcgttcagggcggtgctttccctgtggaagccgatgggctttatgatgtccttgcggtcggtcaggatgttgtatgcgatagccccggaaagcagcgggtcacgctggaatacggtcaggcagttccgtatgctctgacggacaccgcctttctcggtagtttccagccccgccttgatttcctcaatgctctggggcggctgcatggcgttcatggtgttttttagttcttgctgcgtttgcggcggcaagctctgccattcgcttttcaagctgtatcacatcctttccgtagtccgtaatcaaagatgctttttcctctgtctccccaaagagcagcacatccagcagatattccacttggtcttgcttctgtaaggcttccacaaaccgtggatgaaaggcttcctccggggagtgcggggcataatcctttctccatgcccgaagcaagtgaagataatcggcaagaatacggaagcagcggctctttgcttcctgaaactgttcctcctgggatttctgccggggcttgggcttttttaccttccccggcggtttccagtcctcataggaaagcccgaagtcctgtgccagctgtacggcggcttctttctttcccagcccatacagggcggcggcaaaatcaatcacatccccatccgcaccgcagccgaagcagtggtaacgccgatccagcttcatgcttggggttttatcgttatggaacgggcaacaagccatcccgttccggcctacacggattccataatgctccgcagcctgtcttgttgtaacggactgcttcacagcttcaaatacattcaaatctatccctccttgaaaaaaagaaaagcacctgacattctcaatctgaaaatggcaagtgcctgttaaagttccatatcctgttgtttgtgttttgtctgcaccggggcagttctttgtgcttttttctcgtcagccttatcctgcaagacttctttgataggctgtttcttgggcggctctttgctttcttctgtgccgggggtggctttccgtacccagtagcgaatgtcccgcagcttcttcaaatcctcctgtacctcggtcagcggtgttttcagggctgcaatttcttccagaagcgtttcctgctcctcttgcagctccttttgggtactgtccttatcgtccgggtgcttggcaaggtaggcggcggctttcgcataccgggcaacctccgggtgttcctgtttgaatttctcctttgttttcttgaaaaatatcttctggtacttctcatagacaggcttacattctttgcagtctgtccggctggcaagaatcccgtcaatcactttgctgcgggcttcctttggcttcatctgattgcggtaatctgcggctgatttcccggaagattccagaaacgcttctaagtcctccacagtggaaagccccttttgccggagataggacagggcttcgctgactgcctttaagtcctgtgaagtcccccggttctgtccagccctcgtccagtccttccgttcttcctttcgtatctccatgtacttcatcagcagattgggaagaagtgtcgcttcctccgccgctttttgtgcaagcagctctttccgtttttctcccagctcggtaatccagcctttgaggttttggataagctgccggatggacttcatcagactgttggcggctctgatttcccggttcaggtttccgatattcgtctggataccacgcttttccatctgccggacagcagccccctcatggacagtggggacaatatcaagcccctgtctggcataggaacgcaagtccacacgctccggacggtcattggcttccagatagcggttctggatgacctcccattcatgccgccagatttcgcaatacttctggtcgttccaatccaccgtatcctccttgtggcttttccatctgccggacggaagttttatccgttccccgttttcgtcaaggtcataaaccttgcggctcttgggaagccattttccatgttcgtccattgccctcatagtgagcatgacatgggcgtggggattgtgtcccggcggatgggggtcatggattgcaaaatcagcaatcatgcctttggaaacaaactgctgctcacaaaactcccggacaaggacagcatactggtcgggtggtatctctcttggaatggtaagcacccaccgccttgcaagctgggagttccattgcttttccaccgcttcggcggcgttccataaggtattgcggtctgcatacgaccgtggggcgtttgccgggagcagaatttcattgtggacaataccacgcttttccgggtagtgcttcacttgctggtcgtattcacagaacagcttttcgccgctttggtaagcagcggcggcaaccgcagactgtcgctggctgcgctgaacaatcgtgatttcgttgtgtgggcagggcatttcgtgtccctcctttcggtaattggtggatggggtggcgttttaccacctcattttggcagaaaaaaagcaggagacctttttcagatttcctgctcggtgtgccgctgtgaaggcggcggatatttagctgtaaaagttcgggacaagttgacccgatgtgtgggtggcaaacttgaattttacgattttttgtttttcaaaaagtcaatagttcttttcacgataaatacgatacatatcaaacctacaatcccacaaacaatagagtcctttaagtctgcaaatcctcctgtgtactgcattgcataataataaaccgtccatatcagtatcaatacgaacacactaatacttaaccaataagactttttcttcatctaattttcctcacattgaacttccgattagtcgttgacttcattatactttattcgaccgtcaaagtatagagagattttgtaaaacttgtcggctgggaacaacttgcaacgcaaggtgtccccagatggcaagtccacaaaagggtagctggcggcagccagcgcaggggaagcgtagcgtcccctgtttgatttggagcagaccatgactgcggaaaatcacagccctccggtgaggagccttcggagaacgcaatgcaccaacctctgggtggtgtataattgcgcccttagtaaactaaggggtttccggcttcttccgttccagcagttttttcaatagttcctgcgtgtcctgcctgtgaaaaatgagtttcaataacagcatgacatcatcatctgtcaggcgttccggctcttgcagaaaactttccagcataccgccacgggtacagagccggtgcgtccgttcctttcgggtaagctgctttaactggtgctgcaatgccttttcatcattgatggctttccgcagtttcttttcgcttttctccagctcccggttgagcttttccagctttgaggtatcaggcaagggcagcgtcctcctttcccggtatcagcacataaatcctgtttggttctccaacgccctgacgcacccgcatgataagtccggcggtttccagttcattcagagaacgcttgaccgtcatagagctgcgggacaagactgcggcaatggctgtaacagtgaagcagacaaacaggattccgttttcgtcctcctgccctttggatagcatagcgtccaacatccggcagtacatgacctttgcggtgctgctgactggaaatcctgtcaacgctctgggaaagggcatacagggcggcaatggtgtgtctatcgtcataaattcaaaattcattctgtgtgttcctcctttttctttgctcgtttggataaataacgggggcagtcaatcacaaccgcccggaagctctgcctgcacccatgctggcatttccggcataattcgttgtaagtgacacgcccccggtcattgaggtaaaaggaaagctcatgcttcctctttttgctcattctcggcatattgcgcttcctcccgttttcgtgtatggtttcggggcgattttcggcaaaattacagccatagagccgcttaaaatctcccgaagtatcagcgatagggtagactgtccccctatcagattgtcgtgtttcggtatcatttcggtgtcagttcgccagttctccccggtgtcgttcctcccctgaatctcacagcggcgtatcgctccctttggtatgctcgttttggtaagggttcctccatatccctgccaaaagtcatggcactacatcgccggggaagcatatcccacacaggctggtcattcgattggaataatccatcgatgaactacctgtatcatagaacatttttgtgccctgtgccgtatgtccacaaagtaggaattaggggtaaaaatcagaaatttccacgattgcggaaagtgtgatataatccagataagcggcagcaatcaaaccaccggaaaggagcgtgcgcccatgaaaggagcgacaagcatacaggaacgcctttgggaactccgcaaggacaaaggcttaaatctggaagagctgtcagagttgacgggtatttccaaatcagctcttggaagttatgagaaagaggattataaagaaatcaatcatggcaaccttatcacactggcagacttctatggggtttccgttgattatctgctgtgccggacagagaacagggagcagatcaacacgccattgacggagttgcatttgaatgatgagatggttgctctcctgaaaagcggtcggattaacaaccgtctgctctgtgagcttgccacacataaagattttatcaagtttcttgcggacattgagatttatgtggacgggattgccaccatgcagattcaaaacctcaatgcccttgttgatactgtccgacatgaaatcattgaacggtatcgccctggcgaagacgacccccatttgaaagtgctacaagccgcccatatcagtgatgatgaatatttcagtcagatggtacgggatgacctcaacctcattatccgggatattcgagaagcccataaaaaggacagtgagagtgcaccccagaccactgttgccaatgaactgaaagaaaatctggaagcggtcgaaaatttcaagggcagccgggatgaaaagctggttgtcctttactgtaaacagctcggtatcaactataaaaatctgtcagacgaagaatttcgctggctgattcggattctcaaaaaatcaaagaaaatgggaacgcctatcagccaaaggaaaaaacggtaaagaaaaaccgctgttgcatggtttgttggcttccatgtagcagcggtttttgctgggattattcagttgaatttttagaacgacaaactggaagttgtcaaagagaattgttccagtattccgcagtattgccattcacatcatagaatgtaatggttcccgcatttataggcaaaacaatcgcaaaaggtttattgctgtcaatgtcaagcacttgaattgtgttgccgtcatctatttcaagctgtgttacctgttgctgattcatagaaataaatgctcgctcattatatccttctacagtgtactcggcaattcctctttgaacccccgaaagttttccacccccacggaaaaagtatccaaaggaaagaccagggcggttgacatagacggaaaaagaatggtcactcaaatcctgagggtaagaaatatatgcagccatcgtgctggaaacgcttccatcgaccgtccaatcatccttaatcttctgcgacgaacgaatatctgtctccagcttagatgaagtcacgccgatctcattgttcgtataaagaaaacaaacaaataaaatacaaacaagaacaacccctatcacaattttaagaaatatttttttcatgctatcaaaactccttgtcaactaccgattttcttaattcgacaaaccggtatttaactgtctttgctaaaaaaccctataacagccataataaatcctacaggtattaaaagaaaagacgcccacacaataccaatgtatatcagctctaaacctgcaagaatcattattgcaatacctaagagcattaaactgttaccaaacataatttttttcataatgcttttcctccacaacttcaaattgtcgctcgtctacctatccaacttaaacggcacaacatttccaacaacgcgtccaacaaaatatacaatcacgctcctttgcaaatcccgatttgtcataatcattctatcataccgttatgaataaatcatctcttgcaaaataatttcttctgcccggttgtgaatgttattgcaacgccgcacccattccatttcttgggttcgtttcaattcctcggtcacgccctcggcatctttcatctgctccatgatggtgtctaaccgttcctgtgcctgttcgttcaggtctgcaaggtatgtccataactccccggtcaaggtcaatgtgttcaatctgactgggtggacttcccttaaatattccctgtgcatccgtccgtactttccaatagggcggtgttccttcggcagcttcaaatccgggatatagtaatctccgacaaggatataatcaattccgttttccgttattcttggtttcagttcgctcatgttccttacctcctgtggaagtaggctcgtctggtactaactcaatcacatcggtaatctcacaattcagcgtttcgcagatacgggctaatgtgtccatgctgatgtgctttccctctttactcatgttggcaatcatattcgttgtcataccagcggcaagccttaaatcttcttttcgcatatcacgctctaacagtgtgtgccagagtggtttatagctgatgtgcatattgttttcctgcctttctacccataccaccggggcggctgccccggcaggagcttttctcttattataacaccaatcttgtgaaatcacaatttattcttgtagcctgccgctgataccgtctggattggtttttcctttctttttgttccctttaattagccatgaactgtttcatgccctgactttttgcttatgtgtgataaagaagtaatagaagtgtaaaaaattttgccgttcctatccggcacttgcgcagggtgtcggataggtcgggctttattcttcgggcaagtcaatcttgcctacaaagctgtaataaatatcaatgcgctggcggcgtacttcgttctcgtcatactcacattcataaacaacgattttctccaccatttcacgcaaaagagtgtgtgtcagttcttcgatagaaaggtacttgcggacaacgctcataaacttttcagcgtttaccgtggcttcctgtgccttgtccagctcgccctgcaaagcggcggctctgtctttcagttcccgctgctcggcttcgtagtctgcggacatttccatgaaacgctcatcactgattttcccgtttacattgtcctcatacagacgcttgatgtagcgggaaagttctgcaatgcggctctgcacctgttcaagctgcttggctgccgccgccagcttccgcttgccgcccatttcattctgctggataagcagcttcacgaaccgggcttcgtgcttctgtgcataggcggtcactttccgcagattgtccagcacacccgccgtcaaaaggtcggtgcgaatgaagtgcgccgtacagtcggcggtgcgcttcttatagctgccgcagatgtagcaatcctgctttctcttgtcggtctgataccgctgctggtacatcacatgaccgcagtcggcgcagaacagcaagccggagaacaagcccacatcatcgtagcggttggggcgtttgcgctgcttgcgtaactcctgcacccgttcccatgtctgcaagtcgatgattggctcatggtggttctcgaaaatcgcctgtttctcaatgggattgtctatgctgtgcttcatcttgtaggacggtttttccgtcttgaagttcacaagacagcctgtgtactcccggttttccagaagatgaacaacagtattggtcgcccacttacattcatagccggggtggtagcggcgtgtgctgcctgtgcgctggtattccagcgtccccggcgtggggatttgctgctcggtcagcatacgggctatcttggtaggcccgtttccggcaaggcaaagctggtaaatctgcttgactaccggggcggcttcctcgtcaatgatgaaattctcgtcatcgtccatgaggtagccgtacacgggcttgctggtaacaggctttccgcttagaccttttgctttcttaactgccttgatttttttgctcgtatctctcaccatccattcgttgaaaagattacgcagcggggtaaaatcgttgtcgcccattgcgctgtccactccgtcattgatagcgataaagcggacgcctttctgtgggaaaagcatttctgtgtacattcccacttggagataatttcgccctaaacgtgacatatccttgactatgactgtgccgacttttccggcttcaatgtctgcaagcatggcttgaaacccgggtctttggaagttcgcaccactataaccatcgtccgtgtaccagcagagattggtaaagccgttctgcttggcgtaggtttctaaaatgcgcttttggttggatatagagttgctctccccctgcaattcatcttcatgggataatctcggataaagggcggtaataaggttttgggttgtctgtcttaacatggtttcctccgtttctgacagccagccccactattccgtacttcgattgtaccacatggcggggcggcgtgtatagcggcaaaatgtgaaaaatgcttctttaccgcccgtcatattgccgatttttgtgtagcagcttccgcttccagcaccttagccattttgtcggctgcggtttccgtggcactctgcttgaaaaagccggacaccacaagaacagagttccctatgcggatttccgtcacgcagtcggcgggtgcggtgcttttcatgctgtgtttgatatgctcttttttatcggtcataggcaaactcctttcaatcgttcatcagctttttcagccgttccattttctcctgtgccttttccctgcggaaattcacgccggagcagcagacaggggtacacatctctgttacccggtcataaatccgcttgtgggctgtgtccgggggattgttcagctcgtcaaggcttagattggtcgtgacgatcagcggcttttcgcttcggtaacgactgtcaatcacattgtagacctgctctaagccgtactctgttccacgctccattccaaaatcatcaagaataagcagcggatagcggcagagcttggaaatatattcgttcctgccctcaaaggtggcggcaaggtcattgaggacagcggcgaagttcgtcatttttacggagatttcctgctccatgagggcgtttgcaatgcacccggcaaggtagcttttgcctgtgccgacgctgccccagagcagatagccgatgttcccggctttcatgtcctcccaatgctccacatagaaacgggcggttttcatctgcgggtttctgccgttgtcattggcaaaagtccattcccgcatagccgggtcggtaaagcccaggcgtttcagttcttctaccttgtcccggtgctttctctgctgttcggcggcttcacgctccatgcgctgcgcccgctggcagtcacactctgccgggtgtcggtcacgcccgaacagggcaaccttatcagccggaaaataggcttctttcggtgtccggcacttgccgcagtagagtagaccgtcctcacctgtgtagtcctccggctcggcggtggctgctggtatctgtaaactcatatcttcaaaagctggtttcatagactttctccctccttgtagctgtaatcgggtatgccctttttcggggcagctttagcggtatcgtcagccgcccatctgcggatagtggcggcatggttcttgtatttcctcccggtagaagcgatatagccggatagccggtcaatgtaatactcccatttgtcgggcagttctgctttcagttcagaaagctctgtatctgtcaaaatcacatttttatatctgccgtaagctgcgggggcggctcgtcccggttttaactctctctctttttctatctctatatctatctctttctttatctctatctctggtggacaaatgtccgcttttgcttcggacacttgtccactaagccgtttttgctctgaaatcttcattcttgccctgcgcttacgctccccctcggtagaggactgaccgatgaaaagctcgatattgctcatatacaaagccccgttgtccagcggttcaacaagccccagtttcataaagatttgcaaagccctctcgactgtgccgacctgctggcgggtaatggtggctatcatttgggcggtgtaggggatattttcgtcaagctgcaaagtgccgccgtatttcagcgattttaagtacagcttcaagaggatattggaatacagcataccgtcctgcatactttccagcagcacgatagcgtcatcgtcaaaatagctttctttcagtttgaggtaataatatttgcggttatctgacataatcttggttctccttatctgtggggcgggctttccatctctttgaataataccgggggcagagtaccacgatagccctaaaactctgcttgcagtcatgggtacagccccggcaaagggcattgaaagtaatgcggtttcgctcattgaggaagaacgcccattccagccgccgcttcttgctcattctcggcatgaaaaaacgctcctttcttcggtttggtcgggtatgaggggacaggggcaaaatctgtatgttcccggtgccattttcgggaaaaatctgccctgtaagccccgttggaaaggtcaggggtattgcggatagggtatggcatacccccctgccttttgtatggtttcggtatcatttcggggcggtttttaacgctcctgttcatgctttttctgtcggctcggtgtgccgtgtagtatctgctctgcgttccgtttggcggtggcaagctgctcatactcggcttttgcggtgcggtaggtgttgtaagctgcgtttttctcggaaatgagggcttcaatctccgtattcagcttggaagtggcgggcagcttctttcccggtgcaagcacctttagctggcgcagggcagcttcatagatgataaattccgcttcgtgggactggcggtagttctccgcttttctgccggacagctttttatgagcgtcaatggtggggcgggtgcggcggtaatcgttgacaacctttcgcagacttttcttgtcggaaatgctctgctcaatgccccgcagactttcccttgcttcggaaagagctttccggctgctctccacggctgcgtccagcttgtcaaggtcaagcagttcgttctccatgaggaagttgtgggtagccgccatctgtttgaggttgtgcagggaagcccaacggtcatagcccacgcccttgccctcagctcgcttggcttcccggtcaaccatgcgctgcaaggtgttgtctgccggggcggtttttgcggttttttcctctcgcaagcgttccttttgggtgtgggggtattcgggtatggctgtggtctgttcggcggctctgtgggcgttctgcgtgagcagggcaaggacagcagccttgtcaaaatcgtcccccagcttccgggctgtgataggctttgtcctgtccggcgtgaggtaggaaagccgcccccggctctccttgacagttacgccctcccgcaaaagcagggaagcaaactcgtcaaagctgccagcttgggaaagtgcctgccgtatcgtccggcgcagcttcgccttgtccgtttcaaacttggtgggcttggtcggctgtccggtggcttctctggcggcgttctctttatcaagggcaagctgccctttcttctgcgcccagtattcacgctcggtcactcggttcttgctgccatgcaaaaggtcaatctgatacagattttcccggtggcacatctccatgacttcggacttgaaatattccatagctgcgtctgtgcagcggtgcttgcagccgtccttcgtgtccgctggtctgtccatgtagggcagaagcgggacggcttcaatccgcaagctgtttatgacgatatgcacatgaatgttgccagagtgattgtgcccgtccgggtgggtgcagacaatggcttggtgtccggggaaatgctcgttgcaaaattcctcgcccagcgactgcgccttatcaacggtcagaccgttgtccgttccatcccgtgggtcaaagctgatgatatagtggtgggatttcacatcttcccgtttttggttcttgccatagcggagattggagcgcagacaggcaacagcaaaatcttcttcgccgcagttcagcgtggcaaggcggtagccctcacggggaacaagccgcccgttttcatcaagggtgggtttcatggtaaactcgtcatgctcaaaagtgaggtaggcttccgctgctccgtagtcggcatttttagagctgatatgtttgaatgttgccaacagcttcacccactttctgcaagacttcaaacttcaaggctgcaaggtcggaaatggcggctcggacttcgccggacagggcgttatacggtacgccgtattcgttcagataccgggcaatctgattgaggttgccgccgatcctgccgtattcggcggtcagcttcccgacagcggcaagcaattcatcattgaccggggaaacggtaacaatggggcgtatggttgcccgtgtaatggcttgccggataaattcggactggctcataccataaggggcaagccgggcggtaaagtcggcgtattcttcatcggtcagccgggtcttgactaccctgctgcggtggggcatgttatatcgtttcataggtggttgacctcctttctgtgcgtggtgtcctctcactaataggagaaaaacggggtgtgtagcggaactgtttttgaaataatccgaaaagaatttgcgggaatttttcaagcggcgtaagccgcataagcagggtttggggaaggcactccccaacaagattcccgcaaggacaaaatgagcgataagcgaaatttggtactgcggtagaatcttgctctccgtgactgcaaactttctctcacttccgtccgccacttttttggaaaactgcaaccacaaaagtttgtttctctttttctgctactactaatcctgtaaagggcattcctgcccgctttcgctaaaatgacaccggacgcagtggtttctacccggtgttggagaaatcctttctctttgccctctactacgggtaaatgctccaaatgccaaacaccagggcagaaaaattccctcctcgcttactactacaaccggcagggggcaaaatggccgggagcggagccggacaacaaaaaaagcagtaaatctttttcaagacttactgctttcgctggccgcgtcggtggcggctggtattcagtttttatgacttgtccggtggttcgtcaagccggaacttgaattgacagtcaattaaccgctgctttacatagtcctccacctcggcgttgacctgcccgttcacttttgagaaatagcggatatatccggcgtagtggagcaggacagcgttcacggcttctgggtcgccctcacgggctttgaggattgtttcataggggagaagtctactcataccggctcacccccatttcttcgcgtagccgctgcaaggcaagctggatatgccgccccgctgtgctgcgtgaccggccaatacacgcgccgatcacgcgctgcggctggcgcagaaagtaatagcgcaggatttcttcccgcgtctgctccggcaaaacagagatcgcgtcggcaagggcggcgttgcagagcaggacggtctgaccgcagacggtaaatgggtattcctcgtccggctccgacgcggcaaactggacaaacttctcgttcatcagatagtcaagggaaacttgccgttcccattgccgtttaagcttcaaaatcttgtccaaggcggcacagcggataacagtcttgcaaaaggcgttgtacctgcgctggatatattcttgataggctatctggtcggtcatggaaattcccctttctgaataatagtgcggggcggtggcacttcttgctgtcgccccttgattgcctaccagcaaaggcgggcggggctgtcaacggctgcgcatatgcgccgttcatcttgaccgttgactggctcggctgggtttgctatttacccgacaaacttgaatttattttaagctatcacgttttaccttcttaagccttactatcattaccataggaatttctttgttggttttaaaacattcttcataaaatccatcaatgacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcaaagacaaaaattccgctttcctgcaacagttcataaacagccataagaagtggttcaatatccgtaatatccataattgccatattagaaactgctttcgtaaaggctcgatttctttttaattctaatatactttttctatcggtcgcatccgccacacaaaattcaatttgttttgcatattgtgattgccgtcttttagccaattctatcatttttttgctgtaatcaaaagcgacaaccgaagcgcctctttgtgcaagatacgaagaataatttccattgccacacgcaatatccaaaatgtaatccgcaggattaggagatagaagttccgttactttgggacgcactacctctctgtgaaattcattagattcgtcacccattgcattatcccaaaattgtgcgttctcctcccagatttttttactttcctctgttcccatgttctctcccactccccaaatttgcttttttgcttccattaaatcttccttactatattccattgttaccctccataacttctgattgttgccgtcttgacgattatgtatctttacattaccttctgaaacatatggcgcaccttgtccaggcggctgtttggacggcggggctggatgaccggctgaccgacagcggcctgatatcctttcagctctgtaaggcatacgctccgcccgttggtgtaaaaggccagatcagtacggtatgcctgtatacagcgggcgggaatctcgccagtaaagacaacttcatccttttttacctgggccgtttcgatggtggcacagtatttcggtgcatcatgataagccctggaaaggtattcctggggcgcatagaggatgaaggagagataaggttccagcagctgcgtccccgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgagagtggtgtaacagacagtcctatggatgcccaaaacgggttgggcggcacctcgatatggatggtgtggctggctgctttgagcggccgctccatataaatgacggagggttcctttaccactgtttcaagcttgtatttttccgacagcaaagcggaaacaacctccaactgcacccggcccaaaaaagaaagaatgatctcatgggtgatggaatccacttcgcaacgcaaaagcgggtcagtatccgcaagttgcgtaagagcgtccagcagccgttctctttgcgctgccgttttcggcgcaatcgtcgtccgcagcatggggagggggtcctcgcgccaccttttacgagggagccgggtttggtcccctaatacatcgtttaacctcacgctgtcgctgggaaggataacaatttcaccctgataagcggtgtctgtccgaacaatttcccctttggatggaatacgcatctctgtgattttcagcttttctctcccggccagggccaccgtatcccgcaggcgcagcgttccgctgtataaccgtagatagacacgccgctggccgcaatcggtgtactcaaccttgaaaacgctgccgcatagggcggcgcccccctgttccccaatcggttggaacagccctgtcaccgcatccatcaacggttgaatgccaaggccatttttggcgctgccatgatagactgggaacagggaggcgtcttgaacccgctgctgttcctcccgcgcaagtttttcccggctgattggttctcctgcgatatacttttccaataattcatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttaactttacatctgtgccactggaaggaagtgactgccgcttgaatggtaatcccacgctgccgctccaaaaacatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttacagccccaaagggcataaaaatccccagcagtaaaatacttttaccactggggattataagttgcggacatacacatatacagcatacacctgtttgtgattgctgtttttggggatatgtcaaaattgataaggcaaaagtattcttaaattgggtacaaaaaactaagcccctacaaaaggagctatcataatcctttgttcccactatttgattatagttttatttaagaataccttgccgcatattttttactccttttctggattaaatcattgtatcacatcagttttaggaaagcaagtacctaaaagaaatttttcttccccttatatgtaacaatcataccggcttcctagcgttcagaatgttttctgctgtctgctgtggtgtttggttggaattgtccaaccaaaagccgatccgtggtgttgtctgcattttactaaatacaaattcaatgtatacagaaagatataaggagtgggagggattccgccgtagttggcattgtaggaaaatccaaaagtttagattttcccacaatgcttatcttttggtctttggttcggaatagtgtagtgctggcggtctatctcttgttttcggttgcttgcttccttaccgtacatgagcattggagcccggattgtctgaaccgtaaccctccagcagattgactacgccccacacgcccaggccagcgccgagggccacaacaagggtctgtaaagtgtcgatagcagatgcgaaaaactgcatagagcctccttttctccggggagatgccccggccatgaaaaaagccgccattcctggcggcaggttgccacttcgggacactttgtcccgaagcgatatttatacaaaagcgtccggatcgtccacatcgtcatagttgaggatgtcctcgtcctcgtctgtgagcgaagtttccgacacggccaccttgtacacctcacaagcctcgttcagcccaggccgcctgcggcggtttatgagtttatcaaggtcaaaggcgtttttctttttatcggcttccgccgtttgcttatagttgggatgctgcttcaaatcgtatttgggcgagaaaaacgggggcaggccccgcaactgcaaaatgcacttgtcgcccggcatggtcgccagttcgctgggggtcatcagttcccggcccagccgctgggtattctggttgtagctttccgactggccgcgggagcggccctcggtctgcatggagattgtggcctttcccagccagttctcggaaatttccttgattgtgctggcctcccggccacccaggaagatcacgctgtccatatttccgagaatggtctccgcgtgcttatcatagatggccttgcattgtgccaactgctgatagaacaggcacaggctcacctcgcgggagcggatcaccgccaccagcttttccaggtttggcacctggcccgtgttggccgcctcgtcccacagcacccgcacatgatggggcagacggcccccgtgtacgttgtccgccctctcgcaaagaagattaaacatctgcgaaaaggccagggccacaataaagttataggtgggcgtggtatcggaaatagtaaagaaaaccgccgttttccgatctccgatgcggtcaagctccagctcgtcataactcataatttcccggagctgggggatgtcaaacggagccagacgagctccgcaggaaatcaaaatgctttttgcggttttgccgctggccagcttgtattttttgtattgcttgacagcaaagcaattcggcttgcgtttttccaggcccttaaacatatagtccacggtgtttaggaagttttcatcatcctccttgacctccatgccggaaatcatatccaccagcgtattcatgttccgatcctcggcggggccctcgaaaatgatataggacagcagggcgcaatacaaaagcgtttccgattttgtccagaacggatcgccctccttgccgtccccctttgtgttggctatgagcgtatccacaaatttgagaatgtccgcctcgtttttgagataggccagcgggttatagtgcatggatttagaaaaatcaatgctgttaaaaatcttgatcttatacccccgccgctgtaaaaagcggcctacctgggagagcaccccgcccttgggatcaaccaccacgaaagaggaatgagcctggagaagctggggcgtgagccaaaaccgggttttgccggagccggacgagccgatgacacagcaattcaagttccgggcgttggccggatttttcgggcgcgtgttcatggtaagaaattccgtcccggtgagaatgacattattctcaaacttgggatcgacaaagggctttatatccttttccgttccaaagcgggcggagccatactcctcatcccggcggtactttttggcgtttttgcttttcgcgtagatcagcagacggaacgccgccgcgcccacaatgccaacgagccagtcaaagggagcaagccccggcgcaaagtcggcaaaggccgggccaatggtctggcccagccccatgagcttatgagcaacatccgcacccgccgccagccggtaggccgtccccagtttcagacaggcccacaggataaacagataggggatgttaggtatcaaatactttttgagtttatctgtcctcacgggccgcctcctttactcgttctttcttccggggcttttcctttgcaagctgatcctcagcccgtttgagctgttcccggatggggacacggctggacttggaacgcttcaacaggcgtttggagtattcagaaaagcaagctgtcaccgcgtccgcctggccgcttttgaaaaacagcaggtatttgtccggcccggttttataaaaggcataatccacattgaagcggcgggccacccggtcaaactgccggggagcttcaatttcaatgctgtttgtggcggctccgtgggccatgagctggcgcaccgtttgcctgccgtggggcgtctggtgctcccggcgggtctttgcaattttgcggcccgccgcttggagcgcctgggccagcacccgcgccgtcagcttgctggcctttatggatagtgctatggtacgtctggaaacatcctcgtcaaccagctatatccctcctttccccggcgcaccttgggacaaagtgtctccaagtgccgccgttctctgggcccggcgcgttagtggcggccctggcccttgaccgtcaaaatgccgtccagggtggtcgctgtgatccccagccgctgggccaccgcaatatcatttttcatcgcctcggtgatagagtggccgcacaccaccagcacacgggaacgccggagcaggtcgcgggccatgtcgatgccgttcttgtgctcctccggcaccgcatcattgagaaacaggggcagatacagcgcggggcagacaggcgaaaagcccgcctcgtacacgatgcggcagtaccgcgccgcccgttccatattgtcatcgtcatcgccgcaccatgcggcggtaatataagcaaggggtcgtttcatcgtcaaaacctccgtaactgaattgttgggccgggtcaaccctatccccccgccctttccctatccagggaaagggagcggctctggaggatatacccccgccgcgtggccggagatagcacagccggggcaggccgtcaagggcaagccaccgcaagcggcggggcgttccgcccccttgacagcccacctccgactgtgcttttttatccccggcgacgggggatatatcaccacagagccctgcttttccggggcccggcaccttgggacaaagtgtctcgaagcaaagccccgttacttttccagagtgttctttttctccggctttgccagttcgggcggctgtttctctttccagtcgtccagcagggccataatctgttctttcattttggcgggagtgacctccttgccaaaatacttcgacagttcagatgttgaaataatcacgccgcgatcctccttcttttcttcactcaaaatcccgtcaatcacatcgccgttgagcttgccctccttgtcaagctcccggagccgcttggcctggttgaccgagggggaggactgctccccctcaatggaaacagcgatcaatcgctggttttccgggcggatataggacagctccaccgcaggcataaagcccagctttttggcgtccgtcatatccaggagctccgggacaagagaattaagccggatataacgcatgacttttttatagttcatatcgtgatccgcacccacaatctcaacagagcgtttccccagggcctgctcctcctggctgttgccggggcgggccccctggtgcttgatagcctccacctccaaatccagcaggcgggccaactcgctggggaggggctccccgcgctgtttgttgctgttccgcatttcccggacggcttcaaagtccgtcatgttgcggacaatacagggcatttcatccagcccggcccgttcactgccatgatgacggcggtggcccgcgatgatctcatagccctggccgtccttttccgggcggacggtggcgggggtcataacgccatgctccttgatcgtccccaccaggtcatccatcgccttatcgtcctgcaccttgtagggatgctcccggaacgtgtggaacgcatggagctcggacaatttcaaatagacaaccttgccctcctcaaccgggcggggcggctcggctggtgtaggcggcaggttgatctccgggacaggggccgccgcagctttgacgggcccggccttgccctttggcggagacttgggcgggcccatcccgccggagcccttttccggggttttctttttactttgggacactttgtctcgcgtggacggctgagcctcggcgcgggccgccttgtcccccttgggtgggcggcctgcgcggggcttggccgtcttttccgcttttggagacttcggctccgcctgttcctttggcggacggccccggcgcttttccggcttttccgcttcaacggcgggagccttgccgcccttatcatcatcaccccgcacatccgacaggttgatgaccttaccagacggagcagggccgccctcgcccataccggggagcgtcacctgttcggcctgttccggcgcgggcggtgcgccgggcccatccggggctggggactccgggagcttttctccctccgggcccttgttcaatgtttcatctgccattcgctaacctccttttttgtggcatgaaaaaaggccagaccatacggcccggccagcgaaaaatattccccctttccatttttaatttttgattgataccactcctttccctgtcgagccatgaaaaaaacgccccttttgttgatacaaaaagtggcgttttagtgtaggttggctcggtttttgttgtgatttattattatacctttgtcaaagacggttattgatcgaccgatataaggatacttccaaactttatctgattctctgcggatcttctatgtcttttatggaaaaccatgtacttgcctataaagcgccgctttatggaaggagaaccgctcaattcaaattacagcctttcacctttttggaggcacggaaatgcttcaaacggttttccaatttagacttagcaattatctatggggtaatcggaggaacgccgcaatacttaatgcaggtacaagatagcctctctgtggaagaaaacattaagactttgtttttaaatccgaactcccctctttacgaggaacccactaatctactcaagcaagaagtgcgagagccggctctttacaatgctattatttctgctattgcaagcggcagttccaggttagccgagatttctggaaaggtgggagaggaaagcagcgtttgctcagcttatctcaaaaatctgatttctctgggattggtgcgccgggaaaacccctttggggataccagttctcgaaaaaccatttattctgtagaagacaatatgttccgattctggtatcggtttatcccggagaatcagtccagcatcagccgtggcgtagtggaagttgcctggaagcggatagagccatatcttccaggttttatggggcctgtgtttgaagaaatctgtaagcaatatctttggaagctgctgctggaaggcaagtcccctgtggagttttcagatcttggccgctggtggggaaccgatcctagaaccaagaaacaaacagaaatcgatattatgggggcttctggaaaggaagcggccctgtttgcagaatgcaaatggacgaatgaaaaagtggacttggagatattgaaaacattagaggaacggggtaaccttttccgctatcctcaaaaacagttttacttatttgcgaagaatggatttactaaaggctgcgtagagtatgcagaaaaactggggaatgttttgttggtgaactatgaagaaatgctccgataatatgtcgaaatgtcactcaaaattttctaaggattatataaatcttagtatggtgttgattacacgagagatataccattttaaatcttccgccgtaaacgggattacaaaaatttctccacaatctctgcattgcaggagcaatttttctggcgtcaatgccctcttaggtaatccctcatgatcgcactcgggacagcgatcccagaaatcatctttgaccttttcaaaatcagagaagctgccatacagcagctttagaatagagcagcggtgacaaatatccccttccttatcgacttttgcaccgcacacataacagcgaggcgttttttctagttcttccggacgctgtacaaggtcttggcaaccgatctgagaataatagatgagtatgtttgcattgttttcttccatgcccctatttcaactccaatcaaaaatagcagtaatctttttatacagctccattgccttccagccggcgccggttcaaaacggatcgaccatcttgccgcccttgctcataaaaggtgtttgagaattggctgattttcatctgccgtttattctttttgaaattttgtgacagctccgtatatttttgatcttcatcctgtggggtaataaccagcagggcggcagattgggcgtccaactgctcttttagccctttacaaaaccccagtgtataggagttggcaatgccggatgtatccacatggtttgtacgcagttcccggcaaatacgctgggattcgcggttggcgaatcggtaggcgtattcgaatacattctttgcaattcggacatcgctttcatgcccgaaaaaggtaacagccatatctcttaaaaagtatttgacacggaagttaggggcgatgatgtttgccaaataccgtcggaaagaccggctgcccgaatgcttacagctttcggtggcatacttgatatcttcctcggatgtaacatccgtgattccatacttcgccatgagttcatgagcctttaggatagcggcctctgcctcgtgttcagaatgggtacttgctgctttggcaaacagatgctggatggttttctgaatatccatttagttttcctccgtttcctcattcatttcagctaactcttccaacatggaaggcagtccgtcatagtcttcgctttctcctaaaaggccggccatcaaaaaacggttttctttgaaaccccatagtcttctgccaggcttaacaggtattcttttcttgaaagttccatatgagcgctcctaatagaaaagcaccctgtaaaaccttaaagttttacatgaggcgcccatctcagaatgattgtggtattgctttaatcctccgacatctcccggacaataccgctgcggatgtaacgctgaatatcttccaaggtaaatgggatttcgtggacttctccgcagccgtcacactgaaggaccaaagtatccggcgtcaaactggtgccggtgatggagagggtttctgcaccacagttaaaacaatgatcccagaaagtcgcaagaaaaaggtatgtcatattcggttctccgcccaggatttcattcaaagcggaacagcgtgggcagagtcctttctcgtcgggattttccgcgccgcaaaattggcaatgtccttggatgatctgttcgtttgttttcatagtttgcctcctatttgtttttactcagataattccgcgctttttccatgcattcctgccggctgtcacaagctgtcgcaatcgcaaggccaccgcagtcggcactccagaaatacttggtttctcccatcacataagcggtacagcgaaacaacgccactgtttttccatcgatgtgtgtgatttcctgcttctccggatcggaaaagcagtccatagcatcaagcacaggatatcctcctttttactgatttctcatgctttctacatacttcctcaaacttttgggcagacaaagaggcagataccgtttatccttcaccgccacatgttctctgccgcaactggccacatctgggaggaacgttcctatcctgctatcattaacaaatagattgtagatcccgttcgtaaacaagcaggaatcgtcctgctttacataggtgaacagcatcccttctaccaggtactgtcgcccaggttgaaagtagcgcagtccttcctcctgagtgttttggacaacatcttctatagggagttccagttgtccatccggtcctcggtatctcttttgattttccgccaggccgaccccttccagagcttccttttgatctttgggaaatccaaagacccgtcttttgttgccaggttcagcgtatatttcccagccaaactccacgccatggtgtggaaattcgtcccgcagggcgtttatctgctcttccgtagctctgttcaaaaagctgggagagatttcaatcgaatagtattcgcgcttattccatccgcagatgccgggcccccggcatgtgtgaagcagatgaataatacgctgggcctcccaagcaatctcccaggacgaaatcggtccatcaagggaaattccccatgaatggccccaaccctttttgagttcggagaagtaattctcttttgatagcagtacttttttgactgggaagccgcaggccgagagatgactcgccgcattctcgaaatcaaatcgttcaaaaaaatacagatccccgccagtgggggattctccatcaaaatggagtttcccgtagaagttctccatatttaagctcctctcttgatatgatcttccatctcctgttctctgatgagttcctgcatccaggccggaggttttttatgattgtgcaaatcatcccgaaatacaacagcctcccgccggatacctctcgcatccgtaaaggtgataacctgtcggcgtactctgttcgcttttcttagtttcatcttccttattcctttccttaaaatataaaaaccagtcccaagtagttttggaactggttctaagcattttttaaaatgaatctatcagctatgtaaaaataaaaaggcgcaatacacccaataaaaggagtactgcgccaggaaagtagtcataaaagcagcgccgaagctgccaccggggaattccaccgaaggaatcaaaaaaacactgtaaatacagtatatagtgatgttctgaatttgtcaatactatatattggaaagaggacgccaggccgatcctgcgggtacggcagggaattggagagccgaacaggatttatgtgcttgttccgcgaaaacaggattggagaaaatcccaagaatcactataatcaaatatgctgcaacaggagtaccaagaggaatacgccaagtacacgcccatccgggatgacctgatgaagctgtaccaagtgaaatccgtggtggacaccgcccgccgccagcaggagcagacccacacccagcgccgggacagggatatggagcggtaagggacttcccatttcctgccgccagtggtaaaatgaaatcagttttgcgggccgcgccccgctgggacaaatgtcccaaagtgggcggtgaacaaaatataattacgaggtgcggtaatatgaaaaaaattataaatggctttctaaaaaaagaagttcaaaggttcggtttgagtatgacggggtttattttgtgcttgattgcggtttctgttattccagaggtacgcccattgttaccaatctttgccgttgccttttccgtcatcatcattttggctttgagtgcttcagtcgcacgctttttacaaagcaaagcagacatacatagcctatctgacaacgaaactataatgttggaacagcaatatgctacagagcaccccatctataaagttgcgtatggagaaattcacttgctccatgattttattataagcagaaacaatagccgacttattgttattccgttgagcaggattaaaaaggtagatgaacgctttaggcgcgcgggaatccacagggttccttatataacttttgtgctggacactggcaaacatattcccgttgatttttcatcaaggcattataaggacggagaaccagttataaattggttgattgaacggattggaatggaaaaggttgaacgcggaacagaaaaatcaagcatattgcgataatgaaaagagcctcgtcctttgggacatgaccgcccctccccaacctctggacgaagtgtccagccagcgggcggcggaaaaagttgagggaataaaatgggaaactatgttataaataaaatctattcggatgggtacgaaagatttgcgataatagaagatgttgggaaatatataaaaataaatgtgcattttcttgagtatgacgaatatttagaaagtggtgaaaagtctcaaaaaaggaaaaatggagatacattagatggcgacatatcaattcaactgataacctttagtcgaaaagtagatgtaaatgaagctcttatccattttcaaaaaatacaaaagtctccacatatcgaagcagttgtagaagtgactcaaataattgatgaatattccatatatgcgctttcaactgtatcagatagtaacattttggttgagtttgaaaatgcagtcagctataaagtgggagatagagttttggttattggctctttagaattgaacgaaacatcttaacaaaaataatgtgccaagcgaaatatttgcgttgccccacctttggacactttacccatccagccggcagcgggaggaggcgaagcgatgagcaggagagaaatataccgaaggacaaaggatataagaatatgtggaataatattatcttaattatctgctttatgtgtccgcttttatatggatttgtgatttgcagatatgccagctcctattatagttcattaagatggagcagatttgtcacaatcaaaaatacgctattgcatgatctgctcttgttgctggcagtcgaaagagcagaaaaacaggccgattagtttcagttgcctatacagattgcaacaaaatgacgcttttgggtttggctgcacatttgctgttagatagtactgggatcgttgttttctatttttgcatccaagagcgtatcttactaaaagagtgctatctggaaatgattggctcatttgtctgctggatagtatgatttttcgtgaaactgactttataataattttgcaatagcgaagtttatttgtaatctatatatagtgttgacaaaacaaaaattatactatatactgtatttacagtgttgtttgattccttcggtggaattttccggtggcagcttcggcgctgctttcacgactacttttctggcgcagtacccctttcatgggcgtactgcgccttttttgtttttaagcagcactgaatgttgatatggaggcgatagaacagaaaacaaaaaataagaaaattgagactaacagagaaaggaagatcgtttttgaaagaagaaaatttcgaggcatattctctgtcggaactttttcgcagaggaaagatcgacacagactttgaggtaaccgatcagtatgtgaccggcatttgtctcctgtactctgagcggtcctgtcaggattacgaatacatgattcgtgaaaaatcctttgtggaattagaaggaggaaagctcagcgcctgcgtacagaaggcaaaggatctggcttaccagtcggcgatttctcggctgtttggcttggcaatgcccagaaagattttggaagaagaatcttctgccaaactatccataagagagcatcccatcgctttgccggatcggggttcgatgcaaaaaacagaaccgataatgcctcctgcgaaagaaccgcctgaatcggatctgcctcaaagtacggaacttccaggggaagccatagaagaaccagaagaagttccttctatgagtggttctactcagattggatttggcgatcttcgtccggcgtcttctttgctcaagcaggaagaaacgcctttgtcctctaaggatccttacgagatggaggaggaagacacggagatggaaaaagccctggctactccgattaccattttggggaaagccaatctctgcaacggctggttggccgggaaaatattaaaggagcacccggaaatcatcgtcgattttgcgcatcgctatagcgggccgaaagaggatcagaaacaggctttgaggaccctgtatcccgaggcgcttcgccggcttgaccgagctgcctgattgttctttaggaaataatgtgggaggaggttcgcatattgctgtctgactttgaagttgtaaaggaatccgtggatattacagatgtagccgccaaatatgggggcatccaggtgcttcggggaagcaaagcgcactgcccatggcatacggacaaaacccccagcctatctttttatgataggaaccggcgatttcgctgctttagctgcggagaaggcggcgatgcagttgacctgacccaaaagctgctgaatctttcctctccagtggaggcgctggaacggctcaattccgattatcatttggggctgaacctggatccgccggtttccgatgaaagagtgaagcaggccatccaggaacgggaacggcggcggcaggatcgagccctgtatcagctctgggtaaatagttccaatcgaatcttgacggaatatttccgtttgttacgagattggcggcaacagtttgcccctgataaacccgatgaaccggtagatccccgcttcatagaatcgctgcaccagatggattacctggactaccttctgaacgctgtatatattaacggcacgccagaggaaaaaaagcagtttatccgcgccaatgaaaagtggattcgtgctgtcgagcagagattgctgagaggagagatggcttatgcttgtggaaatagagcaggtcttgtcccggctttgggcttccggcctgtcgcagtcccgagcggcgcacgatttagctatgctgcataaccgctgcctgccagagttgattcaagttcaaaagagtatgggttatccgcatgttatgaggattctggtggaggaatccattgaacgcttgctgttacggatgaactctctgggaattgccagcagcgcactgttttttgagcctccaccatactggcgccaatatggcctaactgggcattttatatagatgtacgcaaaacaatgaatgaacagaaaggggttttgattatggcaaacagcacaaaggcaagcgtccctactcgcatcacaactggaaaagtaagattgacttatgctttcatatgggaaccccgcaaaccacaagatgaccaaaggaaaccagacaatgacaacgatcaggatggtaacgaaaagtatagctgctgtatcctgattccaaaagaagatcagcgtactcttaacaaattacagttggcactacaatacgcggttgccgcgggggagaagaaaggatactggcagggaagccgacttccttccagctttaagtcccctcttcgggacggagatcaggagtgcgcggaaaaaggagaggaatacgccggccattggttcctgaacgcatcatcttcgaggaaaccgcatatcgtagaccttaaccgcaacgatatttttgatcaatctgaggtttactctggctgctacgcccgagtttgcctgaacctgtacccattcaacaagaaaggaagtagaggaattggatgcggactggaagcgatacagaaggtggccgatggagaacccttgggcggtgtccaggttgatattgatgaggcttttggcgatgatgaagatatgcaagcctatggggccatgccccagcaaggggctggatttgtccctcaacagggttatgtgccgcaacaagttcaaaccggttatgggaatcagcggttccagcagggcgttgttccgcaacaatccatgaacggccatattccacaacaagcgactcaaagctttacacctcaacagccaggtatgatgaggccccagggaacgcctcatcatcagcaggcgccaaactacgggatgacgcagcctcagcagggattctatcctcagcaaatgaacggagcttccaatgagtttgcccgtggcatagaaaacgccaacagttctttgccgccccatctctttgaagatccctccaataaacaagtagcataattaaaaaaggcgcgattcgcgcctggaaaggaagaatggaaaaggcggcagggatgccgctttttccattgcttgatgaaaaaataaaagtattatgataaaataaaaatagtatacaagaagaaatttttgatagaatatacagaattgaggtgtcaatatgaatcaaaaagcactgcctcttggcatcgacggctttcggaaactgcgggagggggattattattacactgacaaatccatgctgattgcggattttctaaaaactggcgctgaggttacattgattacccgcccaaggcgctttggaaaaacgcttaatatggatatggtcaaggaattctttgatattgaagcgaactcagagggtattttctcagggcttgccatcatggataccaagtggacagaagcgatgaacactacgccggtgatctctctttctttccgggactgcaagggcgataaagccatactgatttttctcgtaaagcaggaacttctgcgggaatataggaggtttgaacactgcgcaaagtacttggcctctatggatcgaacaatttatgatgaaattatcggctgtttggtaaaaagcgatgaggaggtcgtcccgatcagccgtgcgattgccttcctcagccagattgtaagcgagtattaccacaagaaccccattatcctcattgatgagtacgatacgcctatgacctccgcttacacagaagggttttacgatgaactgcgctcgttctttaccgccctgtacgcttccgccctgaaggggaatccttatctggataaggcgctgcttaccggtatccagaggatcgccaaggagaatatcttttccgggctgaacaatctggtggtctgcactgtcaacgaccgggcgtacagcgaatattttggattcaacccgcaggaagtgcaaacgcttttagaaagctacggcttggaattgaacgatgaagtcaaaaaaatgtacgatggttacaggtttgcggatcaggaaatgtataacccctggtccttactcaattatgccagcagccgtgaattggttccctgctgggtcaatacttcttccaataccctgatccggcagacggtcctgaaagcgtccgatagttttttgcgcaagttcgatgaattgatcctgaacggttctattaagacgccggtgaacctatctgcctccttttttgaatttcaggatgacgccaccctttgggggcttctgatgcattccggctacatcaccgtgaaccgggtgctgaatctacaaactgggttttatgaaatacgaatcccgaacagcgaggtgggccaggagttccagaagatcgtcacccagcggacgcggattgaaagcagctatctggccgagatgttctattatctcattcaggagcggaacctggaggagttcaagaaggtgtaccagaggattgtctccagctgcaccagctactttgacgcaaaggaaaatgcataccacatgctgatgctggggatgtgcgtttacctgaacggaacctatgagattagttccaatttggaagcggggaaaggccgcagcgacattaccttgaaggctaaggagcccggttatccccatattatcattgagttcaagcaaggggaagacttggagaagctgtctgcccaagcgctggagcaaattcacgagaagaactactacgacaacttgaccggggagatcttacttcttggcatcgcacatgacaaaaaggattgcgtaatccaatctgaaatgattgaaaagtagtccaaggctgaatatagcgctatcagcacattctaagggaaggaacggcctccgcaggcaacaaaaagctctctccagaatccgaccggggagagttttttatattgactttaataccgcatattagaaaagcagcttgattttgccggaagctagtcgacaatataggcgaataaatatatagttacttgtaagggcagtcgatttttcggctgccctttttactgtctaccttaaagggagcatatcaatacgaacgattataaaatatacactataaacaatgtaatagttgaaattttatatgtaattatttacgaaaattgttgatttttagaacaaaatgaagtaaaatattttcatgtaaagaaataattggaaaaaatggaaaacaataatgtcacacccgccgcatgatataggcatcctttttgcgttgccgtctttgcttacccggtattcctgctatctgttattcagtgtctcctgattttttgctgttagaagaaccgtactggagggcaggcaaatgagaagtaaaaagtggatgcagcccatttgcatcgcgttaattttacttttagcgatgggcggtatatcagtagaggcaaaagaaaaatccagggatgaagaaaaagtcgtcctggtcgcagatctaagcggatctatggcggagattaatcgtgagtatagagtggccgacgcgttaaaattggccggatatctagctcctgcgggaacagaaattgcattaatcggcgtacattcgcaagtagctgtggaatcagaatttttcgatccatctactgcggatggaatggatggatatttaaatgcggtaaataccttgccatatggtggaaatacttgtcttggagcaggtttggaacgggcggtggagctgctggacgcagggggccagattatactggtcgcggatatatcagaaggcggattggttccgactgtggagcctggactaagcgagtgggcggaccgaatagatgcgctcaatacaaaatgtaaggaaaatgatataaaaataaagcagcttgtattccaccagccaaagacacaaaatcgattgggacaagccctgcaatctctttcagacccagatgaaatctatgaagtatcagatggaaacgaactgattgcatgtatgtatcgggttttacgttcatttggcggaacggttgaagatacgatcacagtggccagtgctgatacagatatgcaaagtgttccaattgaacttttaggggatcagattccccgtgtaaggctctttattcctcaaaatgtttctgtacaggcgttttatgcaggtgcgggtctggaaatacaaaaggaagatacatatacagttttagatttgagacggccgtcgagaaaggggctatcgctccaaattggttcagaaggaaaaactgaaattcaattgcttatggatttagacctcgaaatggaggttggcgtggattcaagactggagggagaacttccagaaacgcagatgacaaccgttacagtcaggctttttgataatgctacggggacgcccttccctgctgctggctatagcgggcagcttaaaacgacactccttctgttaaagccaaatggagaaacatctgaggttccctgtatgcttaccgatgatggaaccttgactggtttatttgaaccagacacatttggaatctatcaaataagtgtacagatctctacgccacagttcacgcttcctgctatcacagctgaaacacaggtcttggatatacggccgccaccgccagcagaacccaaacaagggctatccgtttttatggcggctataattggcgcagtttttattataggtgcggttattatagcggtttggcaaaagcgcaggaggaatcatattccgaacatcagtttacctgaagcgggaggcttttttggaaaagtacagatttctactgtgaaatccggaagttctgacgaaatacggccttttactgtggaattagacaggttcggaaactgccgggaaattacattgagagaattgtatgaaagctgtggaattggatgtccattccagcaggccgggcagattcgtatcttgccgggtgcagacgaaacgttgcgggttcaaaacctgtctggagggaaaatcttttttatgggtcaggagcggggctttggccaggaactgcggctttattataaccagaaattctatattgttttgaaagaaggttgcgaggaggtggaaatttatttccgccagatgactggatctcgggcaaaagacagcgccaaagctctcgcagtcagcgtgcgttgataagagcttttgcatagacaagagaaaagaaaggcggcacgatgcgacatggatttgcagcaaacaaatttcaccatgctttggggtgtggtagaccccgatctcaaagatttgcttactttggtgggcaacacgcgggatttgtctgcgcttccggatgctcagatcgacgagattatgacggcgctatgcgtcagcagttattccgagtttgagcggaagtttccgttaaaggcgtatggcttttttgatgcagagaatcaaaagatgcacttccagctgaaccggccggaacatctgccgccggaatttgtgacggaatatccattggatagaaactctccgacaataggtgtgctgtttgacatgattgctgcgcgcagcagacagggtgctcggacagtggaattcgattttgagagcctgacaaagcagctcagtccggaaaagatgcgcgcttctattcagcagatccgcaaagagatgaattacaattatggaaagtatgcggcgcttccggaggaagatcctgttcgtgatgatctggcgcataagctgaacgccctgtttgccgatgcacgggaacattacaataatcctgtgcagatgctggctttggccgccgatgattgtgaacagcgtctattgttgagcggcgcgggcgatgaggatgctaagggcgcaaaaattacagccggactgcttgcgctcaaagaggatggaagccttgaggtgaaagcgttgccgccagcgaatgaaaccgcgctggtggcgatggatgactcaggcagcgtgcagctggcaaatgttttgagcgaggactatgaatcaagcgcaggagattatgcaagtccgtatgtaaaggatcttgtggtacggaccttctcgccgctggcagccacagtcggcagtaaagtagattaccaacgtgaagtcgaaaaccacaacgcttatctctcgctctatacacaggcgcaaaaggactttatggaatgcgtaaaaccagtatgcgagatactgctgggcgtacacctgttctttgaacagtacgaggacaccgtgaaaagtaaaagcgccatgcggccgcggctgctggttgccaattgcgatccggaaatggcggcccgcagcggaaatctcccccgtgttcagactttcttaaataccacaaatctgacaaatgatatgtccaatcatatttggcaggcaattttcccgaatctcagcttttccaaagcaggggatcaaaaagaaatccgtcaggtattcgcgactgcgaagcagaaaaagaagacagatgtatattcaatggaaacactcagcacattgacggacgcccttgcagattatggaataaaaaccttcttttcttttgaaaccggggaagatacgacattcgataaggtggtaaaagaagggataggcgcgtttatagatcgctgtgctccgctgatgaacaaagaatacagcgcctgtgccgtgccctgcctgccgaatgtaactgtgatcccaaagaacaagtccggggttatcactggaaagctgatgacaacggacggcgaaaatgcggcatattcggagcggcaggaagatgtgcagcggttttacttaaacgggatttatgtcccggcggctttcattgcagcgggaatcatggctgcctgccaagatccggatttcctgcgtgaaaaattcatcagaaacattgatccgaccctgccgggggtacggtttgacattgaatcaggagacaacgccctgttggtcccaaccacccttgcgagggaggttgcgggatggacaagatctgttaaagaggaaatcaacaggcagggctttggatttattctgtcaagcgaggtccagagtctcaaaggcaagccggtgaataacctgactgtctataaggcgcgaagtcttgcccatgacggatatcaatatgaaccgatttttcagcagacagtgtcaagctattttgagtgcgtactgcgcagggtcagttctgactttaaaaaagacgcggttgagtttttcttttctgcaaatccatccagtcagatgcagcagtggatgaaccgtaaggattttataaatgcaattataaaaccggaagacgcggttacatacgatctggacgagcgggccggacattgcgagatccacttccaattcggcggcgtacaaaagaatgtcaaagtgaggctgcggcggacgactgcaggagccggcgtttaaatcatggtttgggaagcatgcgattcaagaacattaaaaattcagacaacaggaggaattagcatgactcagttggttatcacaggggcggaaaacattaccatcgacgaaaaacatatcacaaaaatgggctaccggatcgtcacgccggaggattccaatgcgcgctccaccgatgtaagcaagattctctggattgaggggcgtatcattccggaaattgcgggcacatcgggcgagccggtcgcaaaactgcagcaatggagctataaaaacaagggtgtaagcgtttactgtaatgcggttgcacagtatgacgcagacgctacaacagtacgcaagtatacgctgccgaaggcttttgtatatgattaccacgagtcgttcagtgacacacaggggacaggcacgttccgtctggaactttgtcagaaaaaagatgaaaacaacaaagtgacggtcgaaggcggctttgcagcggaataaaccagaaacggaacggaaggagaaagcaaaatgtatgagctgaaaatggaaggtgcgttttcaagccagctcggtgaggaaaccgtaaaatcttttgagaatacaacaggcatcccgaagaatacagagggacgggcgccggatacctccgcgactatgaaatccacagggaaaattcgatctgcggcggacggcggccttgccgatgggacagttcaggttgctcagtgggcaaataacatggatgatgcaaaggcatatcagaaggttactgcaaccgcgaacgcagccggacaggtgttgcggcgggttacattcccgaacgctttcgttgtagggtacagcgaagaattcgacgtgacagccggagtcggttcgtatgagttaaccatccgccagaaaaaggatttactggagaacattttggttgaaggcggttttacactttaatagacagttctcgccctgccaccagcaaaggcggaaaatggatgggcgtgcccttttcatgggcacgcccatcttttataaaggggtgtttatttgtatgaggacttactacgaaacgttgggagtatctgcagacgcaaaaacagaggagatccgcaagaagtatcggcgtttagtgaaagaaaaccatccagatctgcatcccggcgataaggcggccgaggaacggtttaaggaaatcgccgcggcgtgggaaacattaggcgatgaagaaaagcgtaaaaaatatgacgcggagattgcaaaggcaaaaaagggggaaaagcccaggtatgcggctgctcattccgcaccaaccggaggtaaggtagatattggcgcaatgatggaacagttcagcaagatgtttactccagaaggagttgcatcgcaatcggaacgcacaaaagcaggctccgcaccgattgatacagacgaactgtttttcagatttatggggctgaaaaaatagtggggatagtgatatgaggggaagggctgctatctgcatattgctggatgccgttattgcggcagcatcaatcatgtgtgtaattcttacatggatatatgtggaaggattctatttacagattgcattgaccgcggtatgggcggcttctgctgttggaattattggacgtgagatttcctgctgcagaaaacgcaaaaagaaaaaagaaacgacgacgtgtccgcatgttatctgcctgttgggagaaaacgataagacaatccaaagctggccgttggagggacaaatagggctgttaatcggaaaagaaaatccggactatacctgtctgatagatcttacggacagctcgtacagcgactatatagacccaatccatatgtcgttgaattataccgatgcagggtggtgggctcaggatctctctacccgcggcggaagcgcgatctggcgcgacggaaaggaaatttttctggcaccagggcatccggtgctgctgcaatgcggcgatctattggagctgtcacggagcgtccgattggcggtaaggtaggaaggcaggagagatcaaaatgaaaaccatgagcaggacaaatatggcgcagtgtcagatggggcacttatttgacacacggatgcatggaaataaatgtccttattgcgggcgggtggtagggcgtccagaaaaaagggagcctttgccgacgatagaggaattggaagacgaacttttatatttaccgatagagccggtatgcggatggctggcatgcatctcaggtccgcgcacagggcagagctttacattgcacgcgggcaagaatttcattggccgggcggatgatatggatgtgcagatattaggagatatgggcgttgcccgccgtaatcacgcgagtatcgcttacgatccgctaaaccggcagttcgtattggtaccgggagattcggaaaaattggtttatatgaataatcagagcgtctatgaaccagtccggctgttagatatgagcagtatacggttaggggatactgtgctggtattccgcccattgtgcggcgatcattttgcgtgggaggaactttgaggggggacggggttgccatatctcattctatgcggcagttttttggccgcgctttggatcttacgttgtacagtaggatggccaaatggcggaaagctgtacacggcaacagtgcaaacggcggggaaacgggaggtacaggcggatataggccggacgattgtcaaagacggggaaacgatgtttttgctggccgatggaattggccggggagaaaagggcaaatatgcggcgcaaatcgctgtcgacagcgtatcccgcatgtttgaggccgcgggtatgggagatcatccgaagtactttttttctaatgcgttccgggctgccaatgccggtatccttcgccatattccggatgcatccgccgggacgagcttgttgtgcgcggttatgaaacagggttatttatattatgcgcttgctggagactgccgtctctatctgatgcgcaggggtaagctttggcaaataagcgaagggcaaacgattggcagccttgcaagacgagcataccggcagggaaagcttgcgcgtgaatatgcgctttgtgtggcgaacgatagccgcgcctgtaattttgtcggaaaagatggattttcccaacttgaaatctgtgaggtcccgatcaccttaaaaagaggagataaaatattgcttgcaagcgatggagtcgcgcaagcattaacagagcaggaattggctgccgctatgcgaaagaggtggagctgcagcttttgtgcacattggctgatcgcaaatgtggatggaaagaaggaaccggaacaagataatgcaactgtgattgtggcaaaagctgttatagatcaggaggtatggtatgcgaaagaataacagtgcttttgttgcgcgttatctcagcaaagagggcgcctttttatataacaacgatttttatgcaagcgcagaagcagatgatttcgcctgttacctcgttatagatggtttagaacctggcgaacgcgaggatccgtctgttcggctggcggcggaagcggtaatagaatgttttgagcaaaaaccgtccattgggaaaaaagcattgaaaaaatatatcaggaatgcgcaggccgctatgaaaagcagccggctgcattttgcgggcgcatctatcgcagtggttgtaaccaactatcaaaaagtacgctgcgcgtggctgggcaacagccggctctccctgctgcggcatggcagggttgcatatagcagcagggatcattctttaagcgcagatctgaccacaagagggaaactgccaaaagaccagattgctgtacatgaggagcgcaacaatttatcgcggtttttaggcggtaaatatgcccgccctcaagtcagcaggaaattacggcttcaaaacggggacattctggctttatacacaaggggcgtctgggaaaactgtgatgaaaatgatctgctcgccagcacagcggaggcaggcaatgatccggacaaggcgcttgagaatatcgagcgtttgattcttgattcaaacccacagatattggacgcggaaagccagccggaggcaaacgggatcctcacaatgcaaaaagcaacgactgatattgaaaactatacgattgcgcttatctttatcgacaaaatatatcttgatccccgaaggactaaacggatccggctgaccatcatgatattggttattctggcagtggtattgctggttttggggatcgttttatttttgtatttcaaaaaacagcgtgaaaaccgtgtggaaatggaatttgcatttgaaagtgcaatacagtacatagctgacaataattttgttcgtgcgcaggatgatttggatacagcgtttgatttggccggaaaattgaaagacaatgaacagaaaaaacgtatcgacgactatcgaaggcttgcgcaaacggttattaccgcagacgaactgatggaatcgggcgaatacacagacgcgcaggaagcgtggctgcgtgcaagaagccgcagccggcagaccgattttgcagcccaaaaatatattgaacagggactggagcaagcggcgggttatctgagcgtacaggattatatttcgctgggcgatatgctggcggaccgcgggaactacgctgcggcagaggaaaagtatctggaagcgcgccggctcgcagcaggactttattatgaagcaggaaaacagtctgcacttgaagcactggactccttatacggcaaaatgcagggggaaaccgaggctgtaaaggaacaggccgcggcggaatctgcagcggcagattacattgtgcagggcgacaaagcggtaaaagaaggggaccttactgcggcgaaactcctgtatacattagcgagggagcagtatgcagcgttgggtaatgagattgtgcttgcgtcgattgacgaaaagctggcggcattgactcaaaaagagggtgaaaaccagcagcagatagaaacggcggagcagtatatgtctgagggggacgcccttctggacaagcttgaatatgccggcgcaaggcaaagatatatccttgccagggggatttacgcggatcttggggatgaggatggtatgaatgaggcacaggatcggatagatacagtggacggttatatcagtccaaaaaagaattagcgtttcagaatgggagttttgaaaatgaacagacctttgcagaatcagccggatgaaacgaaaatctttatccgctaccggcaggaagaacttgaacggatgacgttgcttcagcttagagatatttgcgagcggcaaaaaattctgcatggcggtctgtatcagctggataaagaccagctcatccggttaattctgcgatttcgcggcagttatgaaccgctgctgattcagcagcatatagatggcggcggggaacgtattgaacaggcattgcggggtgtgaagctgcatttgctgcccgattcccttgaaatcccggcgaaaatcgtggtatgggaggggcttgatacaggttatttcgacggatataccctgccaatgcggcaggaaatcgaaggggtaaacgcagttgtgctggaccgggagggcggcgtctgtgcaatcttcaacataattgctgcgcgggggcgggaaaaactttatttggcccggaacggacagctcccatgccggcaggcagatgcgcgggattatatgctgctggtctttccaaggcagctttcgaaccgcattttcgcgctgtacgatggtcaggatatatccctgccgccagaaattgaggcatatggcgtgcggctgctggattttgtggtgcgcaaacctgtacaggccccaatgcctttgtgtattgactttggcacgacgaataccgcggcgggtatccacgcagatccgttgttctgcgaacagttcggcccggaacttgggcaggttggtttaacacaaaataaaatccactatgtccaatggctggatgaggaggggaataaagccccggttttgccgactataatcggaattgaccgaatcgaggatggcaagccggtctggctgataggccgcgaggcggaaaaactggttatggacggctttttcggggaaggggtttcggtctggtacgatatcaagcggtggctgggagactgtgaacagagtgaagaattatccgaccatcgaggcaaccggattatggcaacgcgccgggaaattatcagagcgtttttgacctatgtgatcaaaagcgcggaacaacggtttaaatgccattttcaaaagctgtatctctcttgcccggttaaacaaaaagcgcgtttcctggcattttaccgtgagatattccctgaatatgatttgcttgaacaggatatggtggacgaaggcgtggcggtgctttataacactatccacagctatattgaaaataattattatgaaaatgggatatggtacaaagctttgattattgactgcggcggcgggaccacagaccttacttccgcggatttttcaataacgaacagccggatttcttataaaatatcgattaaaacctcttatgaaaatggggatacggattttggcggcaataaccttaccttccggattttacagatgttaaaaatagaaacggccaggcggctgacgggggaaggacgaagcctttacgagattacggcgggtatggagcaggaatgttaccgtacagtggatgagcagggaccggcgccgctttatcaggcgcttgatcaggcgtatgaacaggccgaacaggtgatccccacccactggcaggagtatgaaaatgcaagccgggacgaatatcatctggtcagggggaactattattatctgtttactttggccgagcgcatcaaaaaggctttcttttctgacagccgccttcaggcggtaacgctttgttccaatcaggcggccgcatcagaaaatacggaaaacctgtggctgatggctccccggtggaagctggcggcatttatgaatgggaaactggaactgcaaaaggaattcccgactgtgcgtttaggggcgccgacagtgcgcatggttttgaatccggatatctatgacttgatccgccgcttttttgggaacttgaaattggaggagtattccgcaatcaacctgacaggccaaagctgccggatcccattattccgtgatgcgctcaaggagttcattccgggccggtatatccgtacaggcggtaaggcgcaggaggattaccgattgaaactgagttgtttggatggggccatccggtatattaccgaccatcagctcggcttgagcagcgtaaccattaaaaccggcgatgtatcgctgccatgggaactgttcgcttacacccatacgaaccagaaggctgtgctgatcccccgccttagcagaaattctggtattggcacagtatcccggccaatgcaaagcagccgtttgcagctgtatctggaggatgtgcatggcgcagtaaagcatattttttcggtagcctgcccacaggaacaattccaatctgttacctatgaagaacttgcgggaatatatggggacgtcatcccgcaagctgagatagatattattgaaaatggagaaatccgctattttgtttgggcggatgcggctcaatggggctttcatgttcttccggctgcacgcagggaagaaatgctgctcctgggtaatccgcagattttcccctttgagaacgatagctggacagtaaactttttcgacggaaaaaaatgatgtgaggggggttcgcattgtcttttatcagtaaaataccaacctttgcgcctggtccccttcgcaaagaaatcctgtttgcgctacgcgatttgacttgtgtggaacaggaattgcgttatggggaatacagtgatggaattctgtcgggatgccgcctgtacgaatcagggatgaggatcggtgtggaaaaagggatagtcaaatatacagatcgcgtctatacgttgcgggagaaagtcagcgtgccgtaccgtccgaccgatcagtggacggcgttgaaaatccgttttgccccgcagattgctatgaaagaatatatctttcatacaggggagcttgtgctggatgaaaacatgcagcttatgccaaacgagttggaattgggaagattcaagttgaaaaatggatcttcgctaaggaccgaatataaggattttgccgacttgcagactgagtacgatacggtaaatctgacgtttgttcatcaggcgggggttgggaaagcaaccttgcgcccggaagtgacgcaccggttcgcacatgaggcttatcctctggcgcaggacccgcttgatatagcgttttgcgcaaccgcgtttgaagcagtcccggttccaagggattatttgcagcattatatctgccggcggctggggaaaccttacagggaaatggcccatgaagaactgctgccggggcttgcacaagtattacaaatgctgtatgggcgtacgcaccgtccggtggataaattgtcgggtatccggctctttaactaaaaaaggagataggaaatgcagacggaaagccaattgaaaccgattgaaacctgtccaaaggggcaccgttataacacgataaaatatggggatacttgtccggtttgcggctcaaagattgccaatgatcctaaaacggaagatgagtggaaaaaagagatagaattgccgcctgaacactgggcctgcgggatgttggtctgcatcaaagggcttaataaagggcgcagttatctgatccgtgagggcaaaaattatatcggcagcgatccaaacagcgatatttatattcgcggagatgataagatacagccccgcaggcatctggtgatcttgtatgagccaagaagccgcaaaaccatgctgctgccggcagaatcccgagggatgatttatatggaaagacaagcggtttatgaacgcagagatttgcggcatcaggatcagtttgtaattggtacgagtacgtttctgtttttggaaatctgttcagaaaatttcggatgggatgatttgcaggcaggtgattaaatatggatatgcggcgctatctatcggaaagactctccttaatcccggaattgggcgaacgggaaataatgcggaaaacaatggagcaggtatttttaccgctttatgaccacatgatggagaaatatgacaggcttgaacggcgaatttatgaagaaatgcccttcttgcccgggctgtatacaatctgcgctacattgctcccgtataaaaacgctggagattatccctggttggttccgatggacgggacggatttagaacagagacagaaaagctggggaaccgttatggaaatgctgaaagaaaagcatatggctattcttgatacggtttttctgaaggacgattatcttgtttgccggcagatagaaaaatcggatcaaagatatcctgcctatttaaaaataggagaacaggagatcgctgtccgggttaaactgaaacccgctgtccgttaccgggaaaagatccggacactttaccgccactttcaatcaaatgggattccgtgggtaacgcccaatatcccctattgctacaaaatgtttgacgtcgttttgccggaaaatgaaatcaaaggggattaccgtccggaagcgccgctgggaatccgcttcgaatttgatggtaaggaggaaaagtttcaaacgggctttctccccgtctggaatgtgcatacaatcaaggtcggacagtcagcgtttcccgcgccgacgcctgatcggatcaattacgaataccggtttgaacttcctgattttgaagaaagcgggtatcttgttgatttggataacccggaattgatttctatacgcagggataaggatgcgctgattgcagtttcttctaaaaaaggggggctttcatggagcgtgctgaaaattttacagcatgcgccttccgagacagaacagttccctttccctcttacatccaaccggcagaaggatggtttttcggagcggctgttgctttaccatgggacgcagattaaaacacgggcggaacttgccgggcaaatacattcctttgatgcggcaaaagaggcgcgttttgaatcgtttcaattaagcagccagtttatagcaggagaaagctataatataaatacttttattgaggatgaaatccgtgacagccaatatctgaaaaccctgattttaaaattccgctccgccggattccccaattatttaacaagggattatatgagtatgcttgtttctcaggttcagcttgctttcccggaatttcactgtgcaggggtgctcttatgaattatgcatgggaggcgctgctgctggctgaagaatcgggcattaaagaggaacaggttgtttttacacaggcttcggcaataaacccatatttagaaactgcatttgaagacctcaacttaaagggattccaaaatgcacatatccctgtaaatccattatatcgctttgggactgttttcagcgcgctgttggacgaacagtttgaaccggctgcggcctccagagattttttaattgatgttctgtttcatttccttgtgcagatggacttgatggatgggatgtcgagattggaatatcatcgaaagtttatgcaaaaagaggttgtaaatgaccggtatggaaaaggcacaggcggcatttttttaagtttcccccccacacagcgcctgcacattgtagatcatctgcttgcattatataaaaatggggcgtctatcgccttgcttggctcgttgcttcgggttctttaccgtaactcgattatctacctggacacgacgtatgaaagagaactgttaatctatgttggcaggaaaaagacgccggaattggaaaaacaggtgggatttcttatggatttattcgtgccgttggacatttctttgcggttgttttgggatatgcattttgggatcatatcggtagaggaaaccatggaaccggatgacattatgatttattaggatggaggggtactatgccatacggggatgaagaaaacattacggcacgccgggcggcgcaggtcaggagtaaactggatattgcgaaagaggtggaattggggcaatatctgtattccttcaaaacacgtccgtttcccgccctgcatttttccatggtggtaccggaacagatggacgaattttcagccgaagctcttgtggtaaaatacccgtcccaattccggccgcagatcattttaacggttccagacggctcttttgacctgtctttacagcggatggagaaggaaccggtgcagccggagggcattatggagatggtccaaaccctgcgtatggccgcaaaacggatgaatccttcagccgtctacgcgccggttgactggatagacgcggatattccagccgcctgttttgagagctgggtggatttatttgatggggagatatggcagatgacctttggcgcatcaatcaaagggatgcttttaatgggcggcttctgcgctccgaaagaacagtcgcagtcgtggtcggttctggcaagacagatgatagaaacgctccatatactgccggattaaggatagggaggattatttatggacgggatttcgcaaaggctgatgctggcgctgcaagggatgactccgatgtttgtggggaaggattttcacagccagtcgaagtctctggcaaaggatctcacaacgatgatgatacagatggctcagactgagtttcctgccagcagcggcgcgcagacgcaggcgccgcccacgcaggctgaaacagaagtgatagatgaggttgtacatatcctgccgttttacagcgactattatgattatgatgatctgggacttaaaacaggtaatagcgattcagtttctattgtccatgatatgataaagacagcaagaaggctggaagggcttgaggatattgacgcaaagtaccgcggtgaagaatcgctttatacctatcagtccgatgaatccgttccggcttgggaaatgtatctgccctttgtatataaggatttgcctactagaaggacagttgagattgaaacaagcgtaacgggagaaaaaacagttgaaaagcgtcccgaacaagatcagttggaagaaaaattaaagcggcatcgggaacaggtggagagcgcctgcaagctggcctgcatgatttattatggcggctccgcagggactacgccgcaaaccgcttatgaaacaatgttcgatgatacgacgagaatatccagctacggaatgtgggggaaatggtatgaacctataaatggatggcaccgggggattgatatgtgcttagggccagggctaaatatttatgcaatctgtgacggctatccgatttatagtggagactattattttaatgtttttataccggaatttaatatcacggtaacttatatgcatcttgcggtggacagcgcaattgaaagcttgattaatgaggtgaatcagaaaataacgtcaaatagttcaagtaaacaggagccgccagttaaaacacttttggacaactacgaagcaatttgtgagggtatcgaacagggttctattccgacaggcgcagaaacagattttcaaaagttgcaggatgagcggatggaagcgttgcgggagcaaatgcgtcaggcaattcccaaaacgccatcacagttggaaaaaatattaggagatctggaagcgatccaaacgcaaacagaacgccttgagcagattaaagcaaggatgcaggaaattcaaagacttatcaattcaggcagaatatcgcccgggctgcaaaaggaactgaaaaatttatctgcggagcaagcttctttgtatggggaacaaatggcggcgtctatggtttacttaggcgtccccaagctgcagagggggcagttggttggaacagagtctgatataggagctgatggtgttatgcatacccatgtggaaatcaataaaggcttttttacaaccaatattttgcggccgtgggcggatattaattatatgggatataaaacacctggatatgctgagttgtcaaatatcatggaacccaaaatcagcgatattatagaagcaaatcctgaattagagggattttccatgaatccgtacccctatatagacgcatggtttgaagcatacggggaggaacgagcatgaaaaaaatgattctgctgttactgcttttgtggctgtttacaggctgcgcatcaactgagcagacggtttcagaagcagaaagctcaggtagtgaacagctattatcctcctgtgaaagtgagagttccgtacaggaattggaaacagaagaaaacccgacgccatggcttgctgaggaaccgatcagatgcggggatgaacagatacagctttctttcgatgagttattccaaacaagaggatttttggtcggagaatactgggtgtctctacgatggaatagtgtagagggaacaggctatctgcgtgatgtaagcttcaaactatccccatcagattattttccaaggagttgtaaaaacggtggcgcaatattgggaaaggattcatgggatgaagactatctggttggattcaaggaattggataatcacgaggaacatttggcggcacatgacgaaaaacgaccggtacattatgcggaattggaatgctttatctttcaagatggagaatttcgttcgtatcctgtagaaagctggcatcagtccgatagttcccgcgatccaccgttggagatttcttatgaccccgatactcgaacagcggaagtatcttctattttaatgacagcaaaggtgcagatggatactggggaaacggttacggagttttcaaccgagcggctcaaaaaagcgaacgaagaagcgaagtatgtgctatatgccctgaatgaagcggtggtgtccacattagatggaaagtatgagataggggtgatcaatgatgacataaatagtcatgtgtatttttcccaaaatacccaaacaggagaggaaacatatatcgcatacggcagcataccaggatcgagtatcgcaattagcaatgttattgagaagcgcgaaggatatgtgtatcgggagatgacggaaaaagaacgcagagcaaggatggggccagatataactgagattatgaggcttgacggatatacgctttatttcccctattggaatattgcatataacattgaaactggagaacaggtggaataacgagatgaaagaggatgcaagatgaaaaagcataagctcgcatggctgctggcgggggcgcttttgctgaccgcctgcaaaggggcggagccggctccgggtacaagcgcatccagcgcagagccggcatattccgcccttaaaagctccagctcggccgggccggaagaaaatcagccggaacaggctttgaaaaaaggctactattggatagagcccgaaggaggaaaggaaccggaagcagtaggatcaaacatatatggcggcggaccttatagaaccttctggataaaagctgtaggggaggatgaagaataccggtgtaatgcatatttcagcaataccgggaagacggtcaaatcaaaggattacagcgatttgggagtaaatcctttttttgaattcactgttttttcttatttggacgaagaccgcgttatctgtataaatcccttacatatagctgcaggtatagaggatacatacgatagtttgatttttcttgtaaaaagtgacggaacgatgcagcggacgcaaatgctataccagtttttccaacagctaaaaaaggaggatggaacgtttgagccgcagccgtctgaatggggcttatatgacgttgtatttgatcgggagagcggcctgcactatgcattgatagcgaacactccatcggatgattcccagtatatctggtattttgcaatttttgataaagaattcaacttcttggaataccagccggtggatggcgcgttgcaagagtttggggcagaagccttttaccttgactggcaggacgcatatgaggaggcaaaactttcaataaactatattggttcgcataaggtccttgtgacccgtcagtttttcaccataaacagtcctattacatatgcaatttataatcttgaaacaaaagaactggtcatggttaaaccttttatagaagaaatatatatgtatacttcaagattgtcttcaacaccatggggatatgtttatatatttgcttctgtttatccaacaaaagaagcatgggattcaatgattaaaatggttgacgtaaacagtggagaaatcaatgtgatcacgccttttccaaaggaagaaggaggaaagctggaaacgccgtttggggaaatcacagtgaagaatgttactggttatttgacccctacagaccagagctttctgcttttcgtggaatgcgaagaatatgcgtggcagccgcctgaagcaaacagggggatatggccggaagggacctacacagaggcgcttgtaaaatacaatatggacggaacaaaggaatttgtagcgcccgagagcaaacaggcgctatttaaaggtatggatcaggcggggcggctgctgatctattgggacggcgaaaacaacggataggaggcggcggttgatggcgtggatgacaaggcaggacattaccataggaggatatcagctgatggagctgtcccagttccagatacaggctgaggtaaaccagcacggaaagctgtatctggaagggatgctcagtgaagagaccgcgcgccggctggaaacaacggatcaatccgggcaaacgattcaaataattgccgccggtaaggtgatctttaccggacagccggagcggatagaaatacatacatttaacggctgccgcaccatgaaattggaagccgccggtttcagcaatcagctttcgctggttccgcatagttacttttaccaggataccgcgcaaagctatgaagatatgctcaggaaagcggtagaacattgcggcgggagcctgatcgctgtgcagggacaggagcggataccggcgccggttctgcaatactgtcagagcgcatgggattttggcctgcgcacagcctctatgctgcatactgtaattgtaccggatcttgcagccgattatccacagatttgccttggcctgccggaaggaacccgttatcaagtgagtccgtccgccttggaaaagcgcgtcgatttttcccggcagagatatgatgaggctgctcaaacagggcaaaaccacacccggcaggaatatatatcttacatctgtgaggacgagcgtattttttgtttaggggaccgcataaccgcagatggcgatgaatgggcggttatgtcgttgtcccattcttttaaaggcggcgtgttgacaaaccgatacatattgggagcgcaggcaggttttgcacttccctacaggggcaatccggtacagaccggcctgatgctggaagggacggtcaaggctgttgaaggagaatctgtacaagtttgtttacagatcccggacgacgcgcaggaaggaaaagcctcgtggtttgaatatgcgcccgttaccaataatgggatgtatgccatgccgcctgccgggacagcggtatcgcttgaatggatgggacaaaaggatggggaatgcaaggcagtccgcaccgtgcgcggcggtgaaaaactgccggattatgcagaaaggtcaatgattaccgagtatggtaaacagatgaatatggggccgtcggcgctttcatttttgtccgactccaattggatcgggctggaggatggaatcaagttgaacgcaggcggccggctgaaactgtcggccggccggaatatcagcatatggtcagaaaaaaggatttctgtcaggacgccgcagcagatgtttgtgtccataaaagcaaacccttcgagtatctggatggagggtagaaggatacatataaaatctgtccggagcagcttgagaagcaataacagcaaggcgctgaccgcgatgccctgccgcgaaattattaatccagtggcgctgcaagccgggacggtattggcgcttgccggaatgacgccggcaacggctggcggtaaataaattcgcggatgtgggcaagatgaagggatgtgaaaaaggcagatgaaatatttcaggattcgtcaggaggacagggatggacaaaactgcctgataagaggattgataacgcttccctgcgctgaagatctgcggcgcggagaaatccggggccttccgctttcgagcagccactatatcacatcctcttttgacgtccttccggaaattctttgcaaacagatttttatggtatcgcaggacttatttgatttggtgaccttatatcttggagaaacggaataccggaacttttttcttgaggatgagcaggggcggcaggctttttattatatcccgcagcttcctttgatggactgcttatctgaacagagccggtcaaatcctgataaaagccggatagaaaggacggttatcaaagcagggcgggattacccggacatttttcagatctccgggatacgggaccgggtttatatcctgtccctgccgttcgcggaaagcctgctgcgcagaggagccgggggattctttctggaggaagcggcaattgaggaaaaaccgggtacagagaaaaatccgcatatgggagggcgggagctatgacaaccaatcaaatcaaaatcaatggattcccattcatcgatttgctggaggtggaattggagcaacaagtgaatacgcacccaacagcagttgttaaaggacatattgcgcagccggaggcatccttgtttttgcagcaggcgtccgctgaaaaacttctggtgatcacggcaagcgactctgaaggtacggagcatacgctgttcagcggtgttttaagcagcctgtcctgtataaccgcgaacgacgcttccactgttacggttcaggggatcgggcacagctccctctgcgatgtccgcagggagatccgcgtatttcaagatgggggcatgacctatgaacaggtctgccaatctcttaccagccagccagacgccagctttattgtaccggaaaatggggcggatgctgccggcggcatgctggtgcagtatgaagaaacggattgggaatttgccagacgcatagccggcagactgggaacagtcttaatagcggacgcccggctggactttcccaacatttcaattgggattccgagtggaggaaaggtttaccaggaggcccctctggaatatacaatggtgatggatgtagcagcctatcgcgacttgaaagaaaacggcgtgggggctgtggaggatggacaaagggggatttgctttaaaagccgccaattttacagtctgtgcgatcaggtcgttgtcgatggcgttggcaggctggtatatcgccggaaaatttctttagagggcagcgaactgattgcagcctatgagctgcgaacccgtgaaggattccaaacacgggaacggcacaatatgcatctgataggcgcatccctggcaggaagcgttgaaaaagtggaaaaggatcaggtccaggtgagtctggcgtatgatgtggaaggcggtggaaagcggtggttcgcctattccaccccttacagttccccggatgggacaggatggtattttatgccggaaccgggcgatgaaatccgcctgcatttcccaacccaggaggaggacgcggcctatgtagtcagttccacccatatcacacatggagaccgcagcgatccggaggtaaagtttatccgcacccagcgaggacaggagatcacgttcgcgcctgattcgatccatattacagatgggaatggctccagtatccgtatggataaaaaacaggggatcatgttaaaaaccaataaggggattgaaatcaatgcagccgacgacatctccataaaaggcaggagcgaggttttggtagagggcggaaaaagcgtgcagatccggcagaatgacagcttgattcaggtgcaggaaaccattgatatcacagcggctcatgtgagggtacagtaaaatggagataaagctgttggagcaaaatatagagatgatggccggcagtttccaaacggtttttgaaactgcatggggcaggtatcagattttgcagggggctaaaaagaagggggcgctgaatacggtccagatttcctttctgcgcactggtgtcctgctgaaaacagcgtggttccagatcgaccttttggacgaggacgactggggagcgttggaggaatgttgcgaggattgggagatcgggccaatcctcaatgatatatacgaatccacacaggaaaataacaggatctccacagcgcagcgggaaaaacagcttttggcccatgcggagcagtttgccgaaatgtttcaacagatcctccccgcggttattcggcctgtgcgggaggaatatccgcaggtccagttccggtttggagaatatatgggaaccagtcaaacgatataggaggcggcgatatggaaatcatctatccagtcagcggggcgaaacttgtttgcgataagggaacaaggtatgcgcatttttacgccgaatcgcgtttttcaacaataggaacagggagggcaggtattgaaaccgactcttcccccgaaaatgtagccgggaattttttcaaatgcaccgtgactggcgcagaatgtgataaatgcttttcggggaattggcaaaatgtctccagagaagtcacgcagcaggatggggacggttccccccgcggtttgcttacaatgcgctccagcctgcattgcgcccggatggggaccatcacttttttgaccgatgggcaggagatgattgacaatgcaaagatgcaggaattgcagatggggaatctgcgtgaacgggtcaggcggacgatctacgctcattatggctttacaacaccaacagaggaagatattgaggcggtaagacaaaacgccgcagcagcggcagacaccagcgggatgacagaggaagaagctgcaaaggcgcgcgaggaagcgggcgatgcggcggcggaaaacatgaagtcaatggatgataagctgtatgaggaattacgggagctgggcgccacaccggaactgattgacgcaattaaaaagaccggaaaaaaggtttgcgaaggcggcgatcagggttacaaagacgaaagggaggctttcgaaagactaagaaaaagtaatacaaagttaatggaacaagtaccttttgtacatcgtgctgggtaccaaacgcttttgaattcattaaaagacagtcaggaggccctgatcagcgaaggggaatatgatgaagcaagggagcttataacagcggagttggccggcatggacgaggcccaatcgcttaaaatcaagcggagaatcgaaaccaggcagctggcggataaagtgatcgagctgttcaaagtcgatgaggacaaccctgctaaagaacaggacccctgtaccctgctggcgtggctggtactgctcagggagaattacgagggagaggtaacgacgctggagtctctggaggaagctgtggctgccggggattacgaggcttacggcctcatgccttcgcacagaggattctttcgcgaggaagcttttgagggctatttgaaccatgtgaaacagatggcatatgatttgccggtacaatatccgctttatggcggatttatgacatggaattatcggaataaagaaccgacatatgtacttaatacacctggtgatcatacgggagtagatattggcggaggctatgcatatgatctaattgcgccttattcaggaacaataaaacaaaacagtcaattggatggattaggtattgtcgttaaaataagagatagcaaacatgattatcttttgtgtcattgtgcatctgtaaatgaagatatacttttggaatcatttgtacttgcagggaaatatgtggcaattaaggggaatacaggagcagtgcaaatggttgtgcatctacattatgaagtgagaaatgctggtgcatactatgggaacgatctcgatcctaataattatttaccgcagcagatgcaggagatgggtgaattgcgagggagaggaacgaaaaaaccatgtggaattttaggaatatgaagcaaccaataatatttggtttaatcgtgcttatatttactggatgtcaaaattatgaggatattaatataaatagaatatcttcgtcatcaaaaccagttatatcagaaattggtaatacaaaatctgaaaattttgatggagaaaagacagtatctcagccgatcgaatcctctcaacaagaagaactaaatgaagaaaagaaaaatgagcgggaaacaacaaatgtttttttaacaaacctttcaatggatatgcctttacaggagtatacaatcggagattctattttgggtatggaaattacaaatattttatgtaggcaagtctgtgaaggaggagtatggaaggatctacaagtttatgtcgattttacaggaaatctggaggtgaaaggcatacttcactattttaaagatggatcagttacattcactttttcagagagttcttatccagatattccagccttacagatttcatacgaagaatctgaacccaaaatggggtttcctttgggaatctatttggatcgggaactgatagacacactttatacaagaaatccacagtatgaaagtgaaaatgtaaaaattattttttcgaagtttatgatccggtatggagcaggctcatcaatgagtgggacaggagaaatagtcaaaatagaagacgataaagatatttcgagtccggaagaatctgcaggttatacgaataatccgcaagatggcgaaggtaacagtaatgaaaaaaccgcagaaaagtctgaaaccatatgggatcaatatgatattgtttacccggctccagttgagggctatgtaattgtccaacgagggctggtacacgaagttaagcagggactattaaaagaaaatggggagatcgtacttccggtggaatatgattttatctcatcagatttatccgaagggctgctgacagtccaaaaaaacacgaagtttggcgcagtgaatttaaccggagagactgtaataccgattgaatacgaatatctttctaagttttcagaagggcttgcggcttttaagcagaatggattgtggggatatctcaacaaaaaaaatgaaaccgtaattaatccagtttatcaagcggcaggtaactttgttgacggcgtagctgctgttttcccgattagaaaagaggtttggcttgaagattcggatgcaaagattatgaggggtgcagattttatattgtggtctgtcaattacatcgatactgcaggacaaacgctttatgaaagcaatcgaattatgaaagatgcgcagtggaaagattttgctgacttaggctctaattacagatattctgagaaatggcggatttatgattttacaggacagcccattgttgaacaggacatcaatgggctgtatggagaaaccgaacaagggacttattatgtgtgggaccatgtgccgttttggtggggcgaatttcaggatgaacccatatatgaggtagtggagtggaatgaatctataccgtataaagattatacatctgctgaacttgtagagttcgcccatatttttcaatgattttagcgccggttaaataactttctgaatggagagggttggtatggcgatgaaaaaatacagtaagattttgactcttttccagaccgtcaggaggccctgatcagcgaaggagaatatgatgaagcaagggagcttatagcagcggagctggccggcatggacgaggcccaatcgcttaaaatcaagcggagaatcgaaaccaggcagctggcggataaagtgatcgagctgttcaaagtcgatgaggacaaccctgctaaagagcaggatccctgtaccctgctggcgtggctggtactgctcagggagaattacgagggagaggtaacgacactggagtctctggaggaagctgtggctgccggggattacgaggcttacggcctcatgccttcgcacagaggattctttcgcgaggaagcttttgagggctatttgaaccatgtgaaacagatggcatatgatttgccggtacaatatccgctttatggcggatatatgacatacaattatggtgcttacgaaaaaattgaatatccaacacatacaggtgtagatataggtggaacggattctacagaaattattgcagcttcttctggagaaatagtttataaagtaactggcttaggtaatacctatccaacccctaattatggaaattacataattgttaggggtgatatggactatagatattgtcatatgctaatggatagtgctagaactacacacatatatgtagaaactaacgagtttgttttggccggagaattattgggacttaaaggtaattcgggaaattcaacagctccacatctgcattatgaagtgcggcctattgagggcggaggaggatcacatcttgatcctaatacatattttcctacggatatgcgagagaaaacaactttcactgaacgtaaagcttcgggaattcataaaagatgtggcttaaagtttttttgagtgaaagggtgtcttagaacatgaaaaaactaatttgcataatagccatgattataggcattacaggatgtacaattggtgcagatggcgaaatggacatctcagaaccgatctcaaaaagcagcacaattgaaccgatagggtctgcatcctccatagctgaaagcgcccatttggaggaggctgaagccatcagctcagaaaatcaacagaacacctcagcaccacaatttcgttcgcatgattcagtgtggttacagactatttcccaaaactcagaaccggtggaggtttctgttggagatacttttcaagggctgaaggttgaaagccttatatatgaagaaatgctgattgatgaggagtggaaactagatagattggttgtacagttttcaggagaaattgaaaccagtggcgtttactttataaacgaccctgattattttctgaatgactcaacctccaatcttccaacactggcggaatttccaatcagtacaatggcgctggttactgaggatgatggccccgtgtgtccagacatactaaaaaaatattacgaagactttaaggaaactcaaaaacctgtagaagtgcagataaaccgtttgctcatttcaaattattgtattcgatatctctacggatctgatggggtgccttccgctgaagtagtttcgatgactcttgcagaggatgaatagaataatccagtaaacccattaggagaacatttgcactatgaaatccaaggtccaaatggaacatggggaggaacttatggaaactggggtaatacaccaaacagtctaaatccagattggtttttaccatagtttttgggggtaataatttgtgaaaccgattatacgaatttttatatctggttttattctaatttatgcaatagcaggatgttcaaaaaatccaaaggttattattttagaaactgatggatatataaatcaacaaaatgaatcctcctctataaatgaaaaatctttggagaacgcctcatcacagaatttgcaagttgatactgtaaatgcggttccattttccgttgccatgagcgcaacagaagatttaatgattgtgtattccgagaattcgatgaaagaaacaaaatttggaattgcaaatcgggagggaaaaattgtagttcccatagaatatgacaatataacctattacccagataaaggctattttcatattttaagcggtacaaattggaagggtaagtatggtattgcaaatcaatatggcaaaatgatcttgccagtcgagtatgattttattttatctttggacggcagcgtatttacttgtatgaaagatgggttatggggtgcggttgaccagaatggtaaagtcgtggcatcatcggaatatgagtatatttcgcagggaaaggatggtttgttaacactgaaaaaagaaaatttgtggggggcaattaatcagaacggcgaaactgtaattccaatccaatatgaatacctttctgaattttcagaagggctggcagtgtttggacaaaatggtttgtttggttatatcaatcaaaataatgaaattgttatcgaaccgatttatcagcaggcatatccttttgttgatggagtagcggcagtttttccatttatggagttggtttggattacagatactgaaggtaaattgcatgagcagccgtcttttactttatggagggtagaatacattgacattactggaaaaaaactttataacgaaagtcaaatattaaaagatgcaggggtttccccttttgtatcactgaacaaatatacttcctccggattgtggaggatatttgatttatcagaacaagcagttgtaaaagtagatatcaatggactttatgggaggagcaaagagagaaagtatgatctatggggctcaggcatatttagacgggaacaattccgaaacaggcctgtgtacgaggcagtggagtggaatgaatctataccgtataaagattatacatctgctgaacttgtagagttcgcccatatttttcaatgattttagcgccggttaaaaattttactgaataggaaggatgggtatgccatagttagaaatatggaggtgcctgtgaaaaagatcatttttcttatgataaccgtagttttattagttgcttgcacaaaatccacaggcaacattcaaccagatgatcctggatctcaagatcttagcaatacatcggactttcgttaccagccggaaatgaattcaacagaaaacagcatcataccgaaaccaaccgctgaaatttttcaagaaaatggcttatggggggtacgaaagtcaaaggatgtgttgattcccccagtctatgatatgatccaacctaatccatataatgaaaattactttttagttgcactgttagatcagaaccctgccggtgggaaaaaagaatttccgcaggcgaaatggggctgtgctgatatcaatggcgagatcgtaatccctgtcgaatatttccgcctttatccgggtagtcaaagcattgcggcagaaaagagaacggagacttacaaaaaggaaggcgtgggattgctggactataataataagatactggttccctttgagtatgatatgatttcgggattttcaaatgggagatacattatatcaaaacagaatcgatatggagtcatggatgaaactggaaaagaaatgatcgctcctatgtatgataggattctggagttcggaaaaaatggctatgcaatagcatttaaccattataagggaatttgcaaaaatgcaaaatctgattttcagccctccattccggacttctatcttttccaatactctgtgataaaccgggatggggaggcggtctatcaatgcccgtatattttcaaatcaaaagatgcctcttttgcagaaaagttagaattgaaaaaggacggttatcctgtcatccatatagatgaatccagatgtcaaaaggaagttattgaaataaatggagcgtatgggacatggggaagtgtaaactttaaaacctatcaaaatggttatgatacgttttattggggcgaatatgcgggctttcagcccattgagagcattctctgggatgaagcgatgccgattgtttatgaggaatacccatcatgaaactgaaatggcgatatatttgtttggcgggaatgctgctgcttaatgcttgtgggcaaaagcgcctttcggtacgcaccaaagtttggatgcggcacaatctgcatcgactggtgaaaatgaatcgctttggtttagtacagcaggacatctggaaaatcaaatagaaaatgattcccttagctctaatgaagaaaaacaagaaattgtcaaaatagaagacgatacttcttcggaaaaagtgtctgcggttatgaagtcgatcgacgatattgctttccggaccaacatcctggctctgaatgcggcagtggaggcggcccgggcgggtgtggcaggcaagggatttgccgtagtcgccaatgaaataagaaatttgtcggaaaaattctcaaaggcggcagaacaaagccgattgattattgagagtatggtagataagacaatccagggaaatcagcttgcgaacgacgctgctccaattttttgacgagatcgtatccaagtcagagcagattatcaatactatgcgggaaattgtagaggcttcccaaagtcaacagaaccatatgaacaaaataaatgaggaaatttcccatatctccgcggctgtaactgcgaacgctgcctccagtgaacaaaccgccgctgtcacacaacagatgttaggagacgccagagggatttattccgaacttaaacgattccgcctcggaggggatgttgagacagcggaatatgatgacgcaaattcgtttagtatgtaagacagcattcgctcccctctttgagagggactatcggccttccgctgatagtccctctcttgcgttgggcagggcgggcaagatgtaaatcctgccgtttacggcgggatcaaatgcccccgtttgcttaggggctttgacgcccgcctcatgcgcttttagttcgccgccgatatccgaagaccagacggaactttcctcaattcccgattgactttttatttgcagattgtccataacattcggattgcaaaagggaatgttcactacgatgggagctttacccaagaatgttagcccccccccgcggctgaaaaatgctgttgatggagatttccttgatatgcccctcggcattggagagcctttggagaagctgtctgcccgctgcggtcccaatctgctcgactggctgttcgatcacatggacctgcatatagtcaaataacggcttgtattccggggagtcgagaaaggtgacgatctcacagcgccccatagcatcggcgaggacagcaaccccctgcatacaaatatgagagtttcccacaaaaagggcggtacagccctgtgcgagcagccggcagaaaagggcttcgacgtcggtattttcatccgagataaaatagaccaggcgctcgtccacacaaacgccgccatccaacagtgcatctcgataggcgcgaaaacgctccgccgttgtgcttaacgcccggtggccgccgataaagccgatcttgcggtgccctctgcgcagcagatagcgtacgctttcgtaactggccgcgctcgaatcggacaaaaccaggtcggtgttgttgtttaaagggcggcggtcgacaaggacgatcggtacgctctttggcgcggcctgcatgatctccctgtaatcgctcatcgtggtcgcgataatcagtccgtcgattttgccgctggtcaacgaattgaggacctctcgctccttctgcggatcttcatgagtattgactaccaaaagttggtatccttcgtgggagagaactgcctcgattgcactgtttaaaactgcaaagaaaaggttggcaatatccggaatcaaaaatgcaataatgcggctgttgccggtgcgcaggctgcgcgcgctggcgttgggcacataattcagtttggagatcgcttggtatacccgctcggcaatttcccggctgaccggctttgtaccgttgattacatatgaaactgtggcggtggacacgccggcttccttagccacttcagccatacgaacacccaaaaaaacaccccgatcaatagattcatagtattttaacgattaacctaatgaatcaattataaaaaaatacgggatgtttttcaagaataatataggaaaaaatggcgttttcacactttctacaaaaataataccgaaaaattattataaaaatagaaaaattttatactacttgactgataggaatttctattctataatgaccccaaggttaatcgattaaacaatagatcgattgtcaaaaaccggatactaaaaaagaaatgaggaagaaatatgagaaaaatcttggcgttcatacttgccctcgcggcggcgttgactctaacggcctgtgactccggtgttgccaccccttcctcctctgtgcagggggccgctgacggggccgggaccaaggatctgagcgacctgacaattgcatatgtgaccggcgagctgacgacccagatctttcgcgaccaagttgaggcgatgaaagcttattgcaaagagatcggcgtaaattttgtgtacaccgccaacgcggatgaaggcaagcagcttgaggcgtgcgacaactatatcgccatgggcgtcgactgcctgattgtccacacgaccggcgacgtttttgttgagagcatgaagtcctgccaagcggccggtatcccgtggttctcctacgataccaagctggagggcgacgacgcctactatggatgggacaattacgagcttggctgggcgatcggcgagaatgcagctgcatgggtcaatgaaaacttcggcgccggcgacactgtttatgctgccagcaacaactatcctatggcagattttcttgtcacccgcgagcagggttataaagatgcgcttgacgagctgtgtgaggcaaagatcgaatgggtgatcgaggcccagggaggaaccactgacgatggcgtgactgccggcgaaaactttacccagtgcggttatgatctgaaccttgtctgtgcgatcaacgattctggtctctgtggggtttatcaggcgttccaggcctccggctacggggaaggaaagacgttggctctgtttggttgcgattccgaccccgaggcgctttcggccatcgccgagggggggatctataagggaacaatcaacaccggacttgtgagcctggccgatgactttattgatattgccgtgggcttggcgcagggcgatgagagtgcgaagggggatcactggggcgacttcacgctgattactaaagaaaatgtagcggattggatgtaagcgtcccaataatagcgagccatgcgggcgctgtcagacggtactgacaggcgcccgcgcctttattagcttattgagcggcaaagcgcagaactgtttttcagggcggctttgtcaacagcctttttataaaacgaagggagaagagagctatggagaacatccttgagatccggcatctcaccaaaagatatccaggcgtggtcgcgttggatgatttttctctcgaggtgcgccgcggcgaatgtatcgctcttgtgggcgaaaacggcgcgggaaaatccaccctgataaaatcgatcgcaggggccattgtgccggaggaagggaagatcatttttgaaggcagggagtacgattttctgaccccttccatctccaaggagattggtatcggcgtaatctaccaggaatttaacctctgcccctccatgagcgtggcagaaaacatctatcttggtgatcggctggttcccggtttttttcaaaatgaaccgctgatgaacaaaaaggcgcaggagattttggaccaattcaaggtagaggggcttaaggccacctcgctgatccgaaatctgccgaccgcctaccagcagttggtggagatcgcaaagacgattgcgaaaaacgccaaactggtgattatggacgaaccgaccgcgccgctgaccgagcgggaggtgggcgtgctgtttcggattatccgcggcctgaaggaaaagggcatcaccgtcatctatatctcccatcgccttgacgagctgtatgaaatctccgaccgggtggcgatcatgcgggacggccgctatatcaccaccgaagaaactaaaaatgttaccaaggagcagttgatcgcctatatggtcgggcgggaattgaaaaaggattttggggagcgcaatacctgtacaaatgagatactgcttgagacaaaatcgcttggcggaaacggcgtgcagccgctatcgttgaccctgcataaaggcgaggtgctcggcttgggcggactggtgggcgcggggcgcacagaatatgcgcagatgatcttcggcgcggcgcaaaaggagtgtggtgaaatctatctggagggaaagccggtgagggtgcgctccccacaggacgcagtggctcttgggatcggcatggtaccggaggatcgcaaggatcacggtgtgctgctgcggatgaatatccgggagaacacagtccttccaatcttaaaaaagatatctaaccggtttgggtttgtaagcagcgggcgggaacgcgcgattacgcgggaacagtcccgtgcgcttcgcatcaaggctccttctattgaacagaaggtaggcaatctctcgggtggcaatcaacaaaaggtggctctcgccaaatggttggccaacgactgccgggtgctgatcctcgacgagccgacccgaggcatcgatgtagctgcaaaacaggagatatacaacctgatccatgagcttgcagcacagggctgcggcatcatcgtgatctcatccgatatggaggaactgatcggcgtgaccgaccggatgcttgttctgtatgagggcaggctgatgggcggtttggagcgagaggaatatacgcaggagcggattttgacgctggcgtccggcgagtaaagaggaaaggtactttattatgagaaaagtgatggatattataaaagaatacaccatttttattatcctgattgtcttagcgattgtgtttgcaaccaaaaaccccgcctttttaaagatcaccaacctccttaccatcctgcgccagtcctgcattatgggcattctcggcatgggagaaatgagcctgatcgtagtcggcggcctgaacctgtcgatgggagcctgtgtggcgctctcgtctgtgttgattgcgatcctgtcggtgaaagtaggacttgcgtggcctgtcgtaatcgccatcacactcattgtggataccttgatcgggtttgtgaccggctttattatcaaccgcactaaaattgttcctatgatcggcacgatggccctttcaaccattatcagcggcatcgcttatctggcctgcggcgggcttccgatttccggcgtcccggaaagcataaaggtattttatcagggcagcgtcggcgttattccggcgccgatcctccttgcggcggcaatcattatcgttatgggtgttatcttcaaatatacctactttggacgcagcctgttcgctattggcagcaatcgcgaggcggcaaggttgtcgggcattaatgcagaccgcatgtttattgcagcgtacaccatctgcggcacgctttgcggcgtagcggggctgctgatggccgggcgcgttggctcgggcaatccaacctccggcgcgacgctggacatggacgtgctttcagcgctggtgatcggcggcgtcagttttctgggcggcgagggtaaggtcacaaaggcagtgggtggtatcctgcttatcacaatgctgaccaacgggctgacgctgtcgggtgtgaccgagtatgtccagatgattattaccggcggtgtgttcctgctggcagtcatcctcgacagtatccagcataatcaccttaaactgatccgtttttccgctgtgaaaagggcataagggaggcttttgcaatgattggactgtaccgaaaatatcttgaaccagaatatggcgaggctgctccggatgcggtgatcgacccatcccaggagtttgaccttgagcatccgaccgagtttcgcatccggcaaaatttcgaaacgatcgcgggactgaccgcgctctggaagaattgcagctgctttaagcggatcatgactgtgcgcacagtgaacacctttatccaaaagccggctcacacaatcccggtgcgtgtctatctgccggcgggggaagggccgcataaggtgatggtgttttaccatggcggagggtggatgatgaatagtctcgatgtttacgactttatcccacgctattttgccagttacggcgggctgttggtgatcgcgcccgaataccgtcttgcgcctgagcaccggtttcccaaagggcttgaggactgctacgacgccctagtctggacacacaagaatctggccgcgtatggcggcgacgtctccagcgtgagcctctgtggggattctgcgggtgggaacctagctgcggcagtcagcctgatggcgcgtgaccggggggggccggccgtacataagcagttcctctttttcccggccactgtcatagcgccaggctaccgtaccagatcggagctgcgctatggcggcggagactatttccttaggatggacagcagccaaggcagcttggtgcccgcttatcttgaaaacccggacgacgcgaaacatccctacgtttccccgcttttggcggaggacctgcatgggctgcctccggcgatgttcctttcagctgagtgcgaccctttgctggatcagggcttgatgtatgcggcgaaactggaggatcaaggcaacgaggtggagtataggatttataagggcatggtccatgcgttcttgaaccgcccgcagcagaaaacttttgaggcgatggaggatgtaatcgccgccatgccgcctctgaaaaagaataaggaggtctgaagggatgagtatcggaagttttttttaggggcgggcagttccccggcgtttgaactgcgcgagatgcatcttcccgcactcggtcccaacgaggtgttggtgaaaaatatggcctgcggcatctgtggcaccgatgtacatatctaccatggggagaagggttcggcggatgcgactcctccggtagtgctcggacatgagttttcaggtattgtgaccgctgttggcaacaaagtggagagggtgaaacccggcgaccatgtcgcgctcgacccgaatatctattgcgggaaatgtctgccctgccggatgggaaaaaagcaaaactgcgaacatctgtacgccttgggcgtcaataccaacggcggttttgcccagtattccatctgcccggacacacagtgctttcgggtggcggatgggattgattttgatgcagcggctatggcggagccgctggcttgtgccatccatgggatcgaccgggcggatatcaaatccgggcaaagtgtgctggtggttggcggcggcacgataggtctgctgatggtacaactggcccggctggctggcgcgggttttgtccttctcagcgagccggtggagatgcgctgccggctcgggctggagatgggagcggatgccgccatcaatccggcaggcgaggagatccctgcccgcattagggaactgaccgggcgcgagggggtggatgtggtgatcgagtgcgtcggcaagccgtctgctgtgacccaggcgttcagcgccgctggctttggatgccatatcctgctgttcagtgtaccggaggcggactccatcgtgccgctgccattgttcgacatttataaaaaggagctgatgatcgtcggttcgatgattaaccctgatactcatcagcgcgcggtgaacctcattaacacaggccggctggagattaaaaagctgatcacccacacctatggcctgagccggctggaggaggcggtcagaatgcagatggggacggaatcgatcaaggttatggtacatccgcaggagcagtgaggaggggacagaatggctttattacagtgtaaattgttttctaaggcgctgttccggagtgtaaatgtcaatgtctgcctgcccacacccgactcgaacaacgacttttttgacagtgctaaccgtttcccgcagccgggggagaaatttcagaccctatggttgctgcatgggatttcggccgacgaatctgactggcagcgtttttcctccgttgagcggtatgcccaggggaaaaatgttgcagtggtcatgcccgacggctacaacagtctgtacgtggataatccgtggggcggcaattacttcacctatcttaccgaggaactgccggcgatcctgcgctcgttactgccgctttccccaaagcgggaggacaattttattgcagggttgtcgatgggaggctatggcgcgttccgcgccgctctgctcaagccggagtgttacgccgcggccgccagcctttcgggcggcctgacccgcgaggcagcggccgtggaggggattgcggcgcaggttgccgcttggcgcagaaatgcttacggagttaatgaagaatattttgcgcctgaacagcacgaccttgaagtgatccttgaaaaccagcacagggcgggcgcggatctgcctaggctgtatcaatgctgcggtaccgaggatttcctctatgacggcaatcttcgctttcgcgatcatgcgctcgcgctggggacggacattgtgtgggaggaaggcccgggcatgcataactttgacttttgggatccgtatatacggcgtgtcctaaactggctccccctcaaggggaggcttgtgtaatgagagaccatagggacaccggaactcgaagccgcatcttctcacggagctggcggtttccggcaggaagcagcgaagatagcggacgccggatttaaccatccggataatttttcgtctcaaattcaccagactggcgctgcatccagacaagaccggtaagcttggcaacagaagctatagaggcggcatccaggccagccgtcgcatcgctgaatcgcatggagccgggcgccgtcacaattctctctgacaatagtttcgtaccgtcgaagtggttctgcacggaaaaaccggaggacttgtttccgtcgggagttcatcaggcaggctgagttgcttatacggctcacatcaatgcaaacgaataatggattcaaaatttttatctccttacatggatattcaggctcgcaggctttgagatacccatgataaccggagtatctgcaccctcgcatattagaatcataccagaacaggccaatgcgacaacctcatctgctgaaaggacgtccttacctccggcaaacgccaaaaagcttgcggctaacttctggcccagaagaacagagtttccttgaaacaaccttgcggctcaatcggaggaattagaatttgaatctgctgtcctgcagttttgtatcacagtcgcccaaagcttgctgatattcaaaagtgaactaagcagactcactcaaaactgtctgcaaattattatacgagagggttttattgtggagaaaacgatgctccaacaggttatgaccgcgccgggacagatcgccttttgccgcgtacccgtaccgaagccggctaaaaacgaggtgttggtaaaaatcaagcggattgggatctgcggcagcgatattcatgtctattacggtgaacattcgggtaccagttatcctgtgacccaggggcacgaggtttccgcgcaggtcgtgcaggttggctcgggcgttacagggcttcgcctcggccagaaggtcactatcgagccgcaagtctgctgtggaaaatgtcatccctgcacccatggcaaatacaatttgtgcgaaaacctgaaggttatggggttccagacgaccggcacagccagcgaatattttgcagtggatgcctcaaaggtcactcctttgcccgatgagatgagctatgacgaaggggcgatgatcgaaccgctggcggtcacagtgcacgcggcaaaacggtttgaaaagcttgcgggcgcgaaggcggcgatcctcggctgcggtcccattggtatcctgctggcgcaaacctgcaaagcatgcggcgcggcgcgggtgatggtgaccgatgtatccgattaccgtctgagccttgcaaaacaggtgggggcggattttgcagtcaatactgcgcaaaaggattttggagaagcgatgatagaagcctttggtccggataaagcggatgtgatctacgactgtgccggaaacaacgccaccatcggccaggcgatccgttatgcacgtaaaggcagcaagctggtgttagtggcggtatttgcaggtatggcgcaggtcgatctgttcactctgaatgaccacgagctggatctggacacaactatgatgtaccgccacgaggattatctggacgcgatcaaccttgtgagcgagggcaaaattcagctcaagccgctgatgagccggcacttcgcattcgaggattacaaagacgcttacctgtatattgaaaacaatcgtgaaacgaccatgaaggtattgattgatgtggatcccctggaggaatgagagatggaacagaagatcagcaaactgattaccgggctgcagcatttgggtctgccggtcagcgatctcgatgaaacagctgctttttatgaagggggaggctttgaaaccgaatttgcgatgatgaacgagcaggcgagagaatggattgcctttttgcggcgggatgggctgacggccgaagcctatgagaacaaaaaaacaacacagaaagcgggcgattgggatcatctcgcgcttgatgtcactgataaagaagcatctttgcgatggcttcggatgaggcagcacggagggattcatcatgtatgatgttactgcgataggggagctgcttatcgactttgcacacaggagtgatgatgcggcaggttaccccattctggcggcaaatccgggcggcgcgccctgcaatctgctggcctccctgagcgcctatggctgcaaaaccgcttttctcggcaaggtgggagcggacagcttcggacagctgctggccggcactctaaagacggtcggtatcgaaacttcgggtgtgatattcgacccggaggtatttactacgttggcctttgtcaccattgatgcgcagggaaaccgggatttcagctttgcccgcaagccaggcgcggatactcgcctgcgctttgaggaattgaagctggaactgatcgacgactgccgggactttcatttcggcagcttgagcctgaccgatgaacccgcccgcaccgctacccgccgggcggtagtctacgccaaggaaaaaggcaagcttatcagctttgaccctaatctgcgcaggccgctttgggccgatctggagcaggcgcggcagcaaatcctctgggggttggagcaggctgatattgtaaagatcagcgatgaggaaatcgattttctgtggcaggattgcgccccggccgaagcggctatgcggctgcatgagaagttaggtgtggtcatcgtattcattacactcggtcagaacggctgctattacagcggcaacggcaatgcggggtggatcgcaaatccacaggggatccacacgatcgacaccaccggcgcgggggatatctttggcggtgccgctctcagccaggtgctgaaagcaggcaagccgctcgaccggctgaccgattccgagttatgccgcgcggcgcgtttcggctgtgcggccgctaacctatccaccgaaaaaagtggggggatctcgagtgtttgcccgctttctgaagtagaaaggctgatggaacaggcgttttaaataatgcgataatcccctcccaaatgaggcgcagacgcgtttgggaggggatttttttaatggaacacatttcttttttatcaacataaccgttacaattacgcggaggtaacaagagaaagataagccgataatagtttttggaaaaccatacagggacatggacgcttattctctgcatagaagaaaaatacaatatacattggagaaaagatagtcattcagcacttccctcgtgttctgctctctggaagccttgtaaatcaaggcttttttcctgtctaattgtccacgctcgacctccttttccgttcactttctgccgcctgtgaatgttggcgtcacagtccgggcagtatttcccccggttggactttggaacgaacacaccgtcgcagaccgcacagcgtttcaagtccttatcccggaaaatctccgcttccagcgttccattcagcgacaaaagaaataacagcaagaaaccagactatcgagatggcaaagacttccctgtccgatttgatgaaagaacacctggaacacaaggtggaagcaaggcaggatttacagcttttgagcgcccagaagatgggggaacacacgaagcagaaattgaaaaaatcaagattgtgttccttgctatcctgcgggatcttaagaaagatatggataacggagaatagcagaggggaagctgtaaccgccgccacgttccagactatgcgggacacgctggcagagtagaaaaaagttccgctttccattgacgatgtaacggcgatggttgccggacagatcggacaacttgcgccgatggacgaggaagccgccgacctgtttcagaagttagcaaaaaagatgattaagcaggcggaaaaataatctcgcggcgaaaggcgatcggaataatatggtaaatgaaatagaaacttttttaaaatttttctcaaaacttcggcaaaacagccctatctggtgttgtatataatgcacagcgtatccaggacaacgccagacgctacccagacggcttcggagaggcccatctgctgaccggcttgatgtattgcgccgattacggcggcaggatatacgtcggccgcacctataacggcaagcgtattccacatttatccgtaccgtacaggaaacacgggccgcccagcagaccgccgatatatcccaaaagcgtaaacgacttgccaccgcgcagaagcgggccggagaactggaaaaactgatttatgaggacaatgtgctggggaagctgccagacgcccgctatgcagcccttgacgcatagtatgccaaagagcaggacgcctagtttacaggtaggagctgcttgtgcctcctctgttcgcttttatgacacacccggacacatcttccgccttgtaatcttcgaggcaaagaaatataatagatgaaagaagatccggaataccgaaaggaaattatggattggttacgggcagacgctgtagcgtctcatggaaaagatttgcccggcaagggaataaaactcctgctcggtcatggctttcacttccggtaccacacgctctatggcggcccctctggtaatcagacggtgagcgcgtttttgctgctctcctttttcataatactgcttgcgctgttccagccgcttggcccggtgccggtactgccgcagtttggcctcgttctcggcgtactcccgccgacgccgctcctaatttttgctcatgtcggtggccctcttttgcgttaaatatggataaaaaaggccatcctatgggaaacttccgggaaacggtcagggtgtcggttttcaagtcgccggatttcctttttcccaccctcaatctcggcggtcaattcctcgcggattttccctctcggcttcgtcatggctggccgctcatttctgcctgtcggcaaaagaaaagagcagctattttcttggttagaaacaactgctctaaactgatatattcatttttaacaaatgatttaatactgtccgatcatacgaattatttcttgttctgttgccgttatactttttggtcaaagtaagtaatgttgctgcaagaatgcgaaagcctaaaaacaggccgctttagcggcgccctgtaaaagtaatgcgattgacaaacctattcggtgcttcttgggaggcataccagcaatatgcccttctaaggcttgtgcaaaccacgcgtagaacgcgtggttttgatttataaagcggttgataatacgatgtctgataactgtctaacggctgccgtttaaagcaatcaacttctcgataatcttttcccgatattctgtatggcgcggcattcctttgcctaaaccgcctcgttttggaaactggagcttgagaaaaccgccgttcttcaacgtgatcgaacagttgacggctcccataatagcgttttttatctcacagctttgaatatctgccagcggaaaacaaacgccaatatcttctgccacggtctttcttaagtctggcacatgatagaattcatttaaatacttgcgttcttcacattcagatactatcaaatagtcttttgtgataccaatatatacatcaaatctcgatgtttttttcttgtttacttgaagcgtaacaccatgtatacctgccgcaagcgtttcgccgttgggaatgcatgtttccaaaacctgtatcattctgtgctcgtcaaaaatgctattcaaaagattctcacccttataaagatttgatgattactccgtctgtcccattttaacataactttatcaatatgaaaagaatatgcctcttaaaagatggtctttctttgcgaagatgcggtacaggcataatttctatattaagcaaaggtccttatggatgcttgtaaaatttcccttgacggaaatattcaaatcagataaaatagaaaaaaagaataatgagaatctcgagcaaaatagcctaaaaagaggaagtttcttcatggccttttgcctggacccacggatgatcagtctatcacagcggtggtccacggggttgccgtagaaatgcggccgccttcacattttgaaaagagatcgacgaagcgttaaagagacggctttttagttgtgtgcagttatgcctggcggcagacagccatacagaaaagctgtcttatatcgtctgtttcgtgtgtttttgtgaaggctgccacaatttggtgtggcggccttttattgttataaagccgtttaatattgtataaggaggaggcgtccgccttgaaaaaccagtttagtccgacatttgaaaaattgttatctcgtgaggaaatcatcgcttcggtgattcgcagctggactcccgaaagggtaattgaacagattcccgtgactgaggcgttaggacgtatcccatccgcaaaggtttgctctgcatggacacttccggtggttcgatcctctgctggggatggtattgctgttgattcgtcccggtttgcacaggggataccggatacctccggctggatacagggacgtgattttgtccatgccgatacaggggatgattttgacgatgcttttgacgcggtgataatggtcgaagatatcgcgttctccccagaagggcggctgacgatccgggatggggttcaagtctatcctggatacaatgtgcgcccggcaggctctatcgtccaaaagggagaaacgctggcgagagccaatctccctttgcgtcccagagatctggcctgcctccagatgggcggcgtgggacagatctccgtttggaaaaagccggttgtggcctttattccatcgggtagcgagctgattgctccaggcacgcctgtaacccgcggcaaaaatgtggatacaaacagcttgcttgtgcgtgagactataaaacagttgggcgccgaacctctgtgccttccgatcgttccggatgactatgagcctatcctggaagccttggacagcgtcctcatcaaagccgacatcattattttgggaggtggctcatccaagggagcagaggacttttccgccactctgctgcaccagcgtgggaaggtattgtgccatggcgcgcaggcggttcccggaaagccgctgtgtgtcgctatgatacagggaaagcctgtcatcaacctgcccggtccgtttatggcggcctatcatggactggagtggctggtcaatgccctggtttctcattttctgatgcagccaaagcaagcgcgccagactgtgaaagctacgctgacccagcctgtagagggcagcgaaagggtttccatgctgttggtggtagaggtaagccgaaaacgggatggctcgggctattgggcaacgccgtataattttaaaaagattccgatgagccgcacggttgcagcaaatggacaatatatgacgaaactgggggaatcgctgccggccggcagcgagatcgaggtggagctgctgcgtggtccggcatatattccagatgccggctgggattaaggggctgtttgctctattttcaaacaagccctagagagtgtctgaaaatcggggctgctttgattctcaaagaatttcgaaaccagggagggtcctgcggtgctgaccgtaaattcaaacacgatgcagagaattccggagggatatgaatttgactggatcgctcaaaacatcttttttcctatttatccggttattgtggatgatattctggcccgtattccccgccgggacggtgttttgattgatgtgggctgtgggagcgggcatctggggctggcgcttctggaacggacacggtataaaggctgcttgattgatatcaatcaaacggcgttggaactgggccgtgctcacgcgcgggaacggggactggctgaccgggcagtatttatgcggcaggatgtgcattccatggactttccggatggatacgccgatctgattatcagccgtggctcttatcatttttgggcagatttggagaaggctctgacagagatataccgggtattggctccgggcggcaatacatatatcggaggcggaatgggaagcgcggcgttggcagaatccatccgtccgcagatgcaggctgttatgccggggtggcccgatgggccgctgcaacgcagcggtaaaatatcgacagaatatttgaacacttttttggagcgccagagcatccctcatgaaatcgtagaaaaccaggagcagggacgctggatcattatgcataaatagcatggattcggggtgtattatgtcggaaaattggaaggaaaagtgggctgcggcatggccggttctgctggttttgcctatactggcgtttgtgttctcatttggtgttggacgattctccatttcgccgtcggagctgctgcacacattgttttatcattttgcagatcccagtcaaattgtcgattccaatatggaaaccacgctgttcaatatccggctgcctcgtatattggcggtattgctggtggggggcggactatctatcgctggcgcggcttatcaggggatgtttaaaaatccaatggtatcgccggatattttgggggcctccgctggagccggatttggggcttgtttggctatgttgatggagctgcctactgtgtatgtccagatgttcagcttttgtggaggtattttggcggtattcatagcggccacagccacgcgccggttcagcatggacccgattctgggattggtgctgggcggtatgatggtaagcaccctgttccagtccggaacatccaccatcaagattttagccgatgcggacaacaagcttccgcagatcaccttttggctgatgggaagctttaatgtcatgaacaaggcaaagctgttcagcattttaattcctatcggagcaggctttttaattctttttctggttcgctggcagctcaacgtcctttcatttggggaggatgaggccagcagcctgggaattaaaacgaaacgtatacgcagtatggtcatcatcgcctccacgctgatcactgcttcctgtgtttccgtgtgcggcatggtgggctgggtcgggctggtcatcccgcatgcgggccgggccttggcgggaccggactaccgccgcttgctcccggtttgcgcaatattaggctccacctttctgctgcttgtagatgatgtcgcgcgtaccgcctttatggtagaactacccatcggtattttgacctcattcattggcgtaccgttttttatgttcattttcaagtcgggcgtcaataaaggaggcagcgcatgatccaggtaagggatgttgaattcagctatggaaagcaagaggttctcaagggaatttctttttgtatggagaagggagagtttgtttgtgtgctgggcgccaatgggtgcggaaaaacaacgctgctcaaaagcatcctggcttttttaactcctcagcatgggcaggtgctgctttatggaaaggatattcaccagatggatgagcgtgaacgggcgcgaaagattgcgtatattccacaatatcatacgccgccgtttccgtttactgttcgcgacgtggtgctcatgggacgcacaccgcacctcagccgtatatgccgccccactgagaaagactgccggatagccgatgaatccatggaacgtttgggcatcgctcattatgcaaacaaatcctatactgctctttccggcgggcagagacaaatggtcgtcattgccagagccttagcacagcagcctgatcttttgattatggatgaacccacggccagtcttgattttggaaatcagtacttggtattggcgcaggttaaaaagctggcaagggagggaatgggggtgttgatggtaacacacaatcccgaccacgctttctactgtgccgaccgcatcatcgccatggaagatggaaaaatcctttcaatgggcgacgcaggaaaggtgataaatgaagcagtcatgaaggccgtctaccatatgccggtcaaggtacgcagcgtttctttgggagagggacttgacgctacgatttgtatccctgtcccggatttatcgccgggccgcccggccggattttacggggcaagcggcctgaggtgcgaaccttcagccaattgagcgaacaaacagatcaatacgtaaaggagattgaaacaaaccatgaaacgaagtctgtccaaaccgctgctcctgttggcacttgccgcctcactcatgctctcagcgtgcagccagcagccggattcggcgtcaagttcctccgcggccgttcccgcatcgtcggcgaacgcatccgcagcgagccagccaagcagcgataccgtggaaattgtggatatgggcggccgcaccgttaccatcccttccccggaaaatctgatccgcatgtatccggatggttccacatctatgattctgctctatacattggcgcctgataaaatgactgccgcgccaagtcagacaggcagtgctttcagcgacgatcaaaagccctttgtcatgcctgaggtgtgggatcttcccagctatgggactttatccggcaaaggttccttgaacctggaggcgattaaggccgctgatgtacaggtgattctcagcatgggtacaagcgccatcactgacgccgatattacaaccgctgacgagttacaggcacaacttgaaatcccggtggtgctgttcagcggcgacagcgaggattatgcgcaggcatacaggcttctgggtaagatgattgaccgggaggaggacgcggaggctctgattaattataccgcggatatcgtaaagacggttgaatctgtggcagcccaggtaccggaggaagaccgggtgcgactttactacgctgagggcgacgacggtctggctaccgagccggcaagttctaaccgctcctatgtgtttaatactgccggcgctgtcaatgtggctgatgtgggtgcacaggcgggctatgggcagtccgccgtgtccatggagcaggtactggagtggaatccggagatcattattacacaggggacgacaaacgcttatgagacaatcctgagcgaccccaattgggcgacgattgatgcggtaaaaaacggacgcgtatacaaaatgcccagtctgccctatagctgggccgaccgaccgccctctgtcaatcgattcattgggcttcactggatggcgaatctgctctatccggagctatatgatatcgatatcgtggaagtggcgattgactattacaaagtcatgtatcatgtggatgtttcccgaacggatatggagtccttgctggcccaatccatcccacaggagtgatttttcttttatcagcctgcaaaccaacatgggcgtatttgcgcgctgttccacaatcaacgcgcttatataaggcgtcgatgaacccatcgcgtgcggagcaacagaaacagagtaaaaagccagcgccgtttaggcgctggcttttgctgtctatactttgtatgtgggacagacctgaatcaaacaaggccttgtgccatcatggcattggcaaccttgaggaacgcggccacgttggcgccggaaacgtaatcctcaggcgtcttaccgtattcagcggcggcggaggacatgctcttgtagatatccttcatgatattctgcaaccgctgatcgacgtcctcaaagctccaggagagacgcaggctgttctggctcatttccaaagcggaaacggcgacgccgccggcattagcggccttgctgggcacaaacaggattcccgcttcaatgaaagcgtccatggcctccagtgtggacggcatattagcgccctcgcaaaccatccagcaaccgtttttcaacaggctcttggcagcgtccaaatcgatctcgttctgggtcgcgcagggcagaacaatatcgcagggaacactccagatcccttggaagccctcgtggtattctgcggaaggacgggccttgatatattccttaattctggcgcggcgaacctccttgatatcctgaataacagagatgtcaacgccgtccttgtcatagatatagccgttggaatcacacatagcgatgacggtggcgcccaaagaaatggctttttccgctgcatagatcgccacattaccggaaccggaaaccactactttctgcccttggaagctcttgcccttatgagtgagaatttcatttgccaggtaaaccacgccgtagccggtggcctgtgtacgggccagggaaccaccatatgtaaggccctttccggtaagaacgccggaatactcgccggtgatgcgtttatactggccatagagataaccgatttcacgtccgcccacgccgatgtcgcccgcgggaacatcgcagtccgggccgatgtggcggtaaagttcggtcatgaagctctgacagaaacgcatgacctcgtcgtcgcttttgcccttcggatcaaagtcactgccgcctttgccgccgccgatgggcagaccagtgagggagtttttaaagatctgctcaaagccgaggaatttcaggatgccctgattgacgctcggatgaaagcgcaggccgcccttataggggccgatcgcactgttgaactggacgcggtatccccggttgatctgatactcgcccttgtcgtcgacccacggaacacggaagctgacgatgcgctccggttcgacaaggcgttcaagcagcttggccttctgatattcgggatggcgctccaagacgccgcgcagggagttgagaacctcggtggttgtttgaagaaattcaggctcatgcgcgtttttttccttgaccgaagccaagacctgatcaacatagctcattgataagacccctccaaaataaatttttgccgaaaaacggtatacctgcgggggccgcggccgggtattatactaccggagacgatatgcagaaaagacgacaggaaacgaacttctccacttcatatcgagccgcgcccgggcttgcattacatactaattatactgtctaaccggggggctgtgtcaataggttttgccaaaaaaatatatttttttgcatgtatccgaataaagtgctgcaaaaaatggtctttttactccggaaaaatggcttttttacatggaatcaatttgaggtcgtcaaaattataaaaaatttctaattattggaatttgagacatctgatcaaacacccctgaaatgtgcgccaaatttcatatgggcaaaaaagaaagggacgccggatgcgtccctttttatcgatgaccgcctttcttcatcagacggcttgtttggtttgtaatttacatcctgctgagttcacaggcgatctgtgtggcaacctttgcgttgttgtagacgagctggatgttcgccttgaggctcgaaccgccggtgattttctcaagcttatcgagcaggaacggcgtggtatccttgcccttgatccccttggcgtttgcctcgtcgatggcttctgcgatcgatttggagatgtagtcggcgtccatcgcatactcctcggggatcggattggcgacaaccatgccgccgcgcaggccaagatcattttttgccttaaaggcagccgcaagctccttcggagtatccatacggtagtcaaccttgaagccgctcttgcgggtgaagaaggcgggcagctcctcggtctgatatccaaggacggagacgccgtgcgtttcaaggtattcgagcgtcaggccgagatcaaggatcgatttggcgccggcgcagataaccataacaggagtggaggcaagctcctcaaggtcggcggagatatccattgtcgtttcagcgccgcggtggacgccgccgataccgccggtcgcaaaaacagaaacgcctgcaagattggcaagaatcatggtggcggcgactgttgtagcgccgtcctcgccgcgcgcgaccagcacaggaatatcacggcggctggccttggtgaccttcaggccctttttgccgatataatcaatttcgtccttggaaaggccgacacgcagtttgccgccgatgatcgccgtggtagccggaaccgcgccgttgtcgcggatgatcttttcaacattcagcgccgtttcgacgttctgcggatacggcatgccgtgggagatgatggtggattcaagcgcgacgaccggacggccttcgtcaagggccttctggacttcgggcgaaatttcgaggtattttttcagatctgtcatgacaatacactcctttttaaaatatatatgaatgtggatggatagacggtatttattccgcttcctcgggcggcatcatcccgataatatcatagatcgccttggcgctgatgcgcgggctgatggtttcctcgcttgcgatacagatgcttgcggcggccaggccggcgcgggcggtatcctccaatgaaagtccctgccgccatccccaggcaagcgccgccataaagctgtcgccagcgccggtcgtgttgaccgattcagaagcataacaaggcagaagcgcctgcccatggtgattggcacaaaagacgccatcgccgccaagcgagataaagacctgctcaagtcccatgtcaagcagcttttttgccgcgcgccgcaaggagctttcatcggtgatctcgatcccggtgagaagctgcgcctccagcttattgggcttgagcgtatgaatgtgatagagcagccccgcgagctttttggcctttgttgtggaaacggtgtccgcaaagagcgggcagcggcaattatccgcgagatagcgcagcgattcggaagaaaggtttgtatcgacaatgcacaggcttgcgcggttgataaaatcaatctttgtttccaaaaatttaggcgtgatctgattatagatgtccatgtcagcaatggccagcatcatatcgccgtgctcgtctgtaatgaacatatatgtagaggtgacgccgccggggactgtcagcgagttggaaatatccatgccgaccctgcggcatccctcggcaagctgtgcggcatgagcgtcctcgccgaacgcagatataaacttgacgtcctccccgagaagggccaggttgtgtgcgatattgcgtgcaacgccgccggcggagaggctgacgtgaccggggttggaatccttctggaccagcggtgcgtccggatgtccgaagatatccatattgactccgccgattacaacgatatagggatttttctgaaggatgtagcccttgccctgaatcaacccttttttcatcaggttggaaatgtgcacggccaccgacgaacgggtgatgttgccaagctcggcaagctcctgctgtgagatcagcggattttcttcgatccagcgcaggatctgacgctcacgctccgtaatcattaggtcgcctccttggttttaacaattgcttataataataatcttatgcttataatatatcatgcgcatattggattgtcaataggtataagagaaaaatacaaacaaaatcatgcctgtatttttggctataatatgaaaaccggtcggctcacagatgggaatctgtgagccgaccggtttgtgacgccaacttattttattggacggcttttttcatagcggcgacgccgtcgtttgtcatgcgttttgcaatgttgtcgcgtatataggcctgattttcaaggtattggttgaatgcgatgcggtcagcttctgtagacaggaccgataaatcgcggcacgcctcaaaaaacacacggttgacgcgatagatttcttcaagcgtctcagcataaaccttggtatggcgcttgttgctgccgcacgcatcccgaagctgcgtcaagacatgcagcatcgtttcatgccgttctttacaatagtcgtccgcgccgcgtgcaagaatccgttggatggcggccggctgctcatgcaggggaagcggtaaactgtgctcatcacaggcaagtttacagtcggggttcgtttgaccgatggcatataccgccgcttctgtgaacgcaaggccaaatgggtcgcaaatccggcgcaggcgctgatgctgccgggaggtcatgacaaaactggccgccacaaaaagcagcataagtccatatgcgatcagataattggtatccatcagcacgtacccccattcaaagtatggatattcattttcaacaaaacagctatcaaaaatataacataaatcggatgaatcgtccagtaaggatatggaaaaggcgcctctccattgcagagaaagcgccctgtaggtgttttatcagacgacaccgaccgtcagaataatacaggcgtatgtgcgtttttcgccggtcgagatcgccaggcggacctttggctcattggccttgctgtaaaatccccagcgatcgatggtttccagctttacaccgtcaagcagctcgcggaaatccttgaagatcggcggctctgtgccgtcgcccggggtcatgacaagcgcgctttcaatgccgatcgtttcagacagaactttgagcgtgtcggttacggtcgggataccggcagtcaggccgagataaacctttttcgcatcaccgctctctgcgtcaagcggatagttgccgtcggcgatcaggattttgtcgccgtgaccgcacagcgagatggccttcataatttcgggattgatacatgcgtttttcagcatagcagatgctcctaaccttacaaaatttacttttcgttttcgcgcagttggccgagcgttccgcccggatgccatttgacatactcctttggatcaaggccgcggttgacctggagaagaacgctcagccgctggaggacaaatgtctctgcaaggatcgatgcgcgcggcgcgcggttgagcgggccgccctcctgccgcacaccggcgaacaggtgcgcatcgctttccctggcgagccaagatgtgcggtttccggtgattccaatcactttgcagccattgcgcttgatagcggtaactgtcgttttcatttccgccgtttccccgctatttgaaatgcagatgacaacgtcgcccgcggcaagctgtccgcaggaaccgtgcaccgcttccgtgccatggaggaaatacgtcggcgtgccggtagaggacatcagcgacgcgccgtatccgctgacatggcccggttttccgatgccggtgatatgcacgcggccgccctttgcctgcgcgtccagaataagctgcgcggcgtcgatgtattcctgatcggcggcattgtccacaaaatggtcaaattcggccttggccagggaggtaaacgcttccatagcctgaatagcttcctgtttcagcatgggatcaatctccttttcgtctgtggaatgcaatttcatttcaggatatcaagcagccccaggtcgaacccatcaaactgttcgcgctgcatcagctcaatcacatcggccagatgcggcagggacggctgcgcgcccatctgtgaaacggtgattgtcgcggtatagtttgcaaagtcgagcgcctgccgctggttcagtccggcgcatacggctgtgcaaaatgcgccgacaaacgaatcacccgcggcggttgggtccttgacctccaccacatcgacacatgggctgaagtcgatgccgctgtctccggccacgaccgcgccggcactgccgagcgtaataatgacgttctgaacgcccttgccgcgcagagaggcgatgacagcgtcgagatcatcgcggttgacggacttgccctccttgcggatcggaatgccggtaaggtccgccgcctcgtgctcattgggcgatatgtatgtcaggtgtgaaagcagtgcggctgaaagcggcgcgctcggcgcggaattaagcatcacggggacgcccttttcaaaggcgtactgtgcgaccagctcattgatctgcatcggaatttcaagctggagcatcaccatatcgaattcggagacgatgtcgcgtacaaacgcgacgtcgtccggagtgattgccatattggcgcctgaaacgacgataatgcggtttttgcttttctggccctctgcgacctccagcaggatattcccgattgccgactgattgtccgggtcctgaaggatatgctgcgtgtggatgccggccgcctgcgcggaagcgatcagctcacggccaaagctgtcgccgccgaccttgccgaccattgtgacgtccgcgccaagccgcgctgcctgcacggcctggtttgcgccctttccgcccggcgctgtccgaaagcttttgccaagcacggtttcgccggaaccgggaaatttttcggtggaaacaatcagatccatgacgaaactgccaaccaccaggatttttggtttcctgttcatacaatatctcctttattatatcatgttggatgccgtttgcctatagggtatcaggaccgcgtgtgccgccgtgtgactggcggacggcaagcgcagagggaaggacggcgaccgccggatcaggcgaattgcccgcaagcagctcaataagcatgcgcgcgcccagcgcgcccataccgcgcgcatcctggcgcacagccgtgatcggcggggagacgatctgtgtccagtcgtaatcgtcaaatccgacgagcgcaatttgttcagggatgcggatcccctgttcgttgagatattggacaacgcccatcgtcagaacgctgtttgcggcaaatatggcgtcggccccgtaccgcacaagggaacgggccgcattgcgcgcgctttccaggctgtaatcaagctcataggcgatcaggctgaagtcgtgcgcaagccccagcgccgcaagcgccttttgataaccgcggtaacggtcatacgcggaggaaaaatcgagcgtgcccccgatatagccgatgcgccgccggccgctttgcgccaagagttctatggcacgcacagcggcctgttcgttatcggaaccgacaaaaggcaggctgacgccgtcaaggcggcggtcgatcagaacgaccgggacatcaacgccggtcagacattcgacgcgccgtcggctgcccgggacaaacagcacgccgtcaatccagttcttttgcaggacggggatgccgccgagaagaaaatgcgggtcattttcagaataagtggaaacgatcagatcgtagccctgttcctgtagcgtttgcttaacgccgccaagcacatcgaaaaaaaagcaattggtggagttatttggctccgtggaagggatgatgagcgcgatcatattggtgcgctgcgttttaagcgcctgtgcggcgccgttggggcggtagccggttttagcgactgcatcgcggatgagcgccatactcttttgcgagacagcgcgcgtcccattgagcgcatgagaaacggtggtgatcgacagcccggtcatacgggcgatttccttcagccccataagaagctcctttatagtaagaggcagttgcatgaaattgataaaacgtttgcgcgcaaacgttttacataagataagaataccaccgaaaagcaggagaagtcaagctttatacaatcgtgaaaggtgacaaatatttaattgttttttatacattaacccaaaaaaaccaattattagttaaaaatttatggaaagggcttgcaaattaagaacattatgttaatatacctgtagtataggtgaacagatttcggaaacgcaaagtgatcagcagatttaatttttcatcgcgattaaaaaacgccgagctgcttcaccgcaaataacaaggaggaaaagaaatgaaaaagattctcgcttctatgctgtcggctgcaatcgtttcggccatgctgcttacaggctgcggttcatccggcagcgcgccggcagccgacgcatccgccgccggctccacccccgccgcggacaataccggaggcacggcgaccgactatccgaccaaacagatcagtatgattatccaggcatcccccggcggtctgtccgatacgaacgcgcgcgccatcgcgcagcttgttcaggaggatttgggcgtgcctgtcgtatgcacaaacaaaccaggcgcctccggcgcggttgcaatgtcttttttgcaggcgagcaaaccggacggatataccatcggttatgtcccggttgagctgtcaatggttcaggcgcttggttatgcgacagatgtctatccggacgcgttcgacctgatttccggatgcaacacgcagcctgctgcgattaccgttcgcgccgattccggctggaacagcattgaggaccttgtcaattatgccaaggagaatcccggacagcttcgtgtcggaaactccggcacaggttccatctggcaggtcgccggcgattcttttgcaaacgcggcgggcatcgaggtcaaccaggtaccgtttgacggcgccgctccggcggtcgccggcctgatgggcaagcatatcgatatggtttccgtctctgaattcgaggtttcctccggcgttgccagcggcgagctgaaaatcctggccgtttgctccgaggagcgcagcaaatttaatcccgatgtcccgacgctcaaagagcttggatacgatgtgaatgtcagcgcatggggcggcttcgcgcttccgaaggatacccctgacgacgtcaaggaaattctgtatgcctcgtttgaaaaggcggtcggttctgacagctatgccgagctgtgtgcgaagaaccaatattctccgctgcttttgaaccatgatgaatttgcggcgttcgccaatgagcagtatgagttctacaaaagctattttgagcagaattccgtgacctgatccggttgccaggcgtattttcggaaacgggccggccgtgtgtcggccggcccgtttccattttcagcagctcctaatattgatagaaggtgatgttgcttggataaaaagaaatccgcattcaatgccgatgtcgtcattggggtattcggtatcctgctgagtgtctggtggattgtcatggcgctcggtttcccaggctccacagccaaggacggcacgccgggaccggcggttttcccaatcggtacggcggcgattttaattgttctgtctgtgctgatgattctggccgggctgaaaaataagacgacttattttaatttccgccagatggaccgcgacaacaagattgctctggcgctttcggttgtatgctttattctgtttctcattctctggaattatgtccactacattgcggccagctttgtaatgtcctttggacttggcgtcctttatcggatgaagccagtcaaggctgccctgcttggcgcggttttcggcgcgggcacctattttttctttacaaaggtgctcatggtcatgcttgacatcgcacgataacaaaagggggctgcacatatggaattgctttggtcgacgctcgtcggcatttttacgacagatgttttcttttattgcctgctcggcgttgtggccggtatggtcatcggtacgctgcccggcctttccgccacgatgggtattgcgatcctcacgccgctgaccttctggctggagcctgcgcagggcatggccgtcctgcttggcgtttataattcggccatctgggcgggcggtatttccgcgatcctgatcaatacgccgggaacgccggcgtccatcgcgcagacctttgacgggtatgcgcttgtcaaagaggggaaaattgccaaggcgctcaatatcaacacaatcttttcgtgtttcggcggacttgtcggtacgatcgtcctgattgtcgcgtcgttcccggttgcgcgctttgcgctcagcttcggccctccggagatgttcgcgctgtcctttttcggcctgtccatgatgatcggcgtttcaggcggcaacatcctgaaaggactgttcgccggcatcgccggcttcatgatctccaccatcggtcttgacccgatgttctccgtcccgcgctttacatttggaaatgtcaatctgctctccggcgtccagttcgtcgttgtgctggtgggaatgtttggcgtcggcgaggtgctgtatcaggtaagcaaccgtgtcaaaggtgaacagacgcgcaaggctgagatcaagcgcgtgaagggcgacagccttctgacaaaaaaggaatggaaggactgtgcagttcccacggtgatttccgctctgatcagcgccgtgatcggcgcaattcccggaacaggcggcgatattgcatccattatctgctggcagcaggcaaagaacatgtccaaggacccggacagctatggcaagggaaatattaccgggctttgcgtcacctcctgtgcgaataatgcggtgatcggcggcgcgatgaccacaatgatgacgctcggcattccgggcgacggcgtaacggcggtgcttattggatcgctgatgatgtacggcatgcagcctggaccgcagatgttcgttgaacacgccgatttcgtgtacaacgtcatggcgctgatggtcgtcggctacatcatgattatgattcttggtcttgcttcttcaaagctggcgacgctgattctcaaggtaaagcaggaagtgatctgggtgatcgtcgtcggcttctgcgtccttggctcctatgcggtcaacaattcgatgttcgacgttatcgttatgttctttgcgggcatcatcggctttatctgcaaaaaagcggatatcccgcttggacccttcattctggcgttgctgctcggcccgattgccgagtcgaatttccgccgcagcatggcgctgtccatgggcgacgcgtcaattttcttcacgcgtccgatcacagttgtcctgctgctgctcacagccgcttcgctgatcgttccggttgtccgcgagggtatgaaacgcaaaaaaagccaggtccccgcttgacgctggatgatggtttcatttaaaatggatgtatggataagcgttgaaacgtcttaataggggaggacgatggtggtgaggacgctgcaaaacatcgattatgaagtgaaacgcgaaaatttatatgaaacagttgcggaaaagctggaggacagcattctcagcggcaacacgcaggtgggcgagcgcctgccgtccgagcaggcgctcgcggaaagctttggagtcagccgcaatgtgatgcgtgaatcgttaaagctgctcaaggaacgcggattgatcgattcgcgcatgggcggcggttcatacattacaaagccggaatcaagcgaccttgtgaatgttgtcaaccggattattctgatggacaacattgattatgaacaggtctttcaaatgcgcggcattttggagagcgccgcgtgttcgcttgcggctgtaaaatgtacgcagcagcaggtcgcacgtctggagatgatgaaccgtcaactgcgggaggccgctggcaatcaggaaaaaagcatgggaatcgatgtggattttcatgtggaaatcgcccggctgtcgggaaatccgctgctggaaatgttcgtggaggttatggcgcatccgctccgtcggggaatcgccgccggctacaatatcgatgatgggaaccgggacgcatttatgcgtcataacaacatcatacaggcgctcagcgagcatgatccgcataaagcgcatgccgctgcaatggaccatatcagccattcgctggataacatccgggaacgggaaaggatgaggatgcagtgatctttgattcgattgcaaatctggagaaataccgggagaaaattgcctgtgtcgatggtattttagcttttgttggcagggctgatcagttgaaaaccggccggtatgactttgacggaggctttgtgctggttcaggagggggtgacgcgtccgcctgaacaggcgcagtttgaagcgcacgatatttacgccgatttacagcttctttgcagaggcggcgagcgtgtggagtgggctgaccgcgccgtactttcggagtccgtgccatatgatgcggacaaggatatcgctttttttcacggctccggcgtcgcgttcgatcttatgccgggcatgttttatgcggtttttccgcacgatgcgcataaacccggctgccatataggcggcgagcgccctgtgacttaccgcaagcttgtattcaagtttaaagtttaacaggacggcgggacatccgccatatatccggtccgttgtcaaagggtccggaaaaagattgggaggcaatcagtcatcatgaaaaagttatttggcgttaccacagctatgaccacgctgtttactgcggacggcgcgccggatgtgcaggcgatgcgcgagctgacggacttcttgattgaaaaaggtgtgaactgcctgtatccgcttgggacgacgggcgaaatgctccgcatgacagttgaggagcgcaagcttgtggccaaaacggtcgtcgagcaggccgctggacgctgcacagtgttcattcatgttggagcgatgcgtcaggaggacgcgattgaactggccaaacatgcatacgaaatcggtgcggacggaatcggcgttgtttccccgcagttctttggagcgaacgaccgtgaaatcgaggaattttacgttgctgttgcggggagcgttcctcaggattatccggtctatctttacaatattccgcagtgcgcggccaacgatataaaaacatgtgtggcgcagaatgttgcaaaccgctgcaagaatgtaatcggcatcaaatacagctatcccgatttcatccgtacatatgagtatctcgaaatcaacggcggcgatttctccgtcatgcagggacaggacaagatgtttttcccggcgctgatgatgggctgcgacggtacggtttccggcatctccggcgtgtatcccgagccgtttgtcgcggtctataaagcgtactgcgacggcgattacaagcgcgccaacgagcttcagcatgtctgcatcaagtattgcagcgcgctgcgcggcggcagcaatatggcctatttcaaagaggcgctcaaaatgcgcggtttgaaatccggccacatgaaggcgccgcagcttgatctgacgcctgccgagattgaggagttgaaacgcgatctcgacgcgatcccggaaaaatattgattcattcattgctcaattgaaaagcggtgcagtcgagggctgcaccgctttcgttttgattcaagccatggtataataaccgcagagcggttattataccaatcttatggccagggcgatacgcgggcgcggcccgcttttgccatgatggtcaattataccatgccgcttcacggacatggcataatatgcgcagtgcaaacggcaaggccgtttgcagccgccatctggcggcgcccgctgcaaagcagcggactgcgcatgttgcaccacagctaaaaccggcaaagccggtttgtctgccgccttgcggcagacaagccccattcgggcttgccgctgtggtataataaccgcagagcggttattataccgtcttatgcccgacggctcgccgcttacgcggcaaccgccttttgacgggcaatgataccatgccggtcagaagggaatcgtcccgcccggatggggcggtttatgagggattatattttgatgaaatcgcggctggagatgggcatcaagccggcgcttggaatgaggtgttatttgttggactgcgacgctcttttagacatcgtctgcgatatcggctgcgagctgctcgaaagcggcgcggaaacgtaccgtgtggaggaatcggtttcccggattgtgcgcgcctttgccggcatggaggcgagtgtatttgccgtgccgacatgcgttattgtttccattacacgaacaggcggcggaagtgaaacaaagacgaggcgcatctatgcgcggggaacgaatctcgaccgtgtggaacgcctcaatgacctttgccgccgcatttgccgcggagaacttgagattgggcaggcgcgcagcgcgcttgaggagattcgtaatcaggacgcggccacgccgcgccgccgcatggcgggctttattctgatcgcatttgggttcacgctgtttttcggcggagggctgtcggattcgctgtgtgcggctgtgatcggcgtggcggcgttttttgtctgtcttgttatgcagaggttggaagcgaacgctgtgtttatcaatattgtggcgggcggcgtaatcatgctgctggcggttggcgcggtatcggcgggtttggcgcaaaatgtcgataaaattgtgatcggtacattgatgaaccttgttccgggcgttgcgctgaccaatgcgatgcgcgacattatggcgggtgattatctcgccggtcagacacgaatgacagaggcgctgcttgtggcgactgcgattgcgctcggcgcgggcgcggcgctgatgctgacgcgtttgctttgaggaggatgcttgatgaatatcctgcttccatgcctgtattcgtttataggatgcattggttactgcctttcgtttaacattcgtccgcgcaagcaaatgctgctgctttcttcagcaggcggcgcgttgggctggtgcgtctatctgctctgcggcggtataaaaaacgatattatccagtcattttttgccatcatagtggttgccgtctattcggaaattatggcgcgcctttataaagcgcccgcaacagtatatctggtggtggggctgatcccgcttgttccaggcggcggcatctactatacgatggaatactgtatcaacggcgatatgatgaattttatgaatacaggcatccatacctttggaattgcgggtgcgctgtcaattggcatcctgctcgtttccggcggtgtacgcctgcttaatgtcgtcggccgcctgcgcagaggcggcgaggaatagagctgaaaatggcccccggctttttagccagggtccattttcaaagccatgggaccgggcggccccttcagcgcggacgtttcctctgcgcgcaggacacctgtttcatagtcaagctcaggcatatttgcccagaaacgcttggccatatgtgtcatacgacacttgggattatagcggccttcgacggcaatggatcggtagtaacgccgccacaggtcgcgaaaacggcgctcggcgtcgtcggcaggaggtaaggtcagatcgtccaccggacggatgatcgacgcatacgggcggtaaaaaagtgcaagcccatgcgtgcggtcaaagatcataaaggtttcctcgggaaagcgcgcggaaaaatgtgcgcccatctcagcgagtacgattgactttggatcgatcacgcagacaagcgcgccgccaaaatctgaaaaacgcgcaaattcgatcagcaaatgcgcttcattgcgctgcgcgcgcacaaggcgaaaaagcgccgccgtgctgcgctctgacagcaggtccgtgacagcgggaccatattgatatgcagcgcggataaaatcgaatatgacgcgttcgcgcccggcggcgcaggaattccagccgtcgcgtatccagccgcatacctcgccgcccatgcgcacgagcgaatgccagacgcggtcggcgtgcgctgggacagctgcgatatcacgtattggaaaaagcgtcgcggcgtccggttccaaaaattcggcgggccattcgcggcgcgtgtagctttcaaagacgcagcagagcagcccctcaaagctgccgtcgctgcggtatgcgggaccctggacaaacggcggacgcggactgccgcttgtcacagctgaccggtcaggcattggaccgcctccgttcggctgggaacgcggtcgaacagggaaagctgttccggcgcatcgccgggaagggcggccagctcataatcgcgctctgagatcagcgcgcgcagcgcgctgtccggtgtgattttgaccccggcggccgcgcgtcctttgcataaaagaaagtattgcgcgcgtttgagaacgacgccgatgcggcgcaggccgtcgaaatcgaggcttgcgcggctccgcgccgcgacgatgcgctgcgcgcttttgacgccgacgcccggcacgcgcagcagcagctcgtacggcgcggtattgacctcaacagggaattgctccatatggttcagcgcccaattgcatttgggatcgatcagggggttgaagctctgatgcgtttcatcaagcagttccgacgcttcaaagccataaaaacgcaggagccagtcggcctggtaaagccggtgctcgcgcagcaaaggcggcttggtatcgatggaaggcaacagcgaatcggactgaaccggcatataggcggagaaaaatacgcgcttgagcgcatattttcgatagaggctctgtgtcagccgcaaaatctgaaaatccgtgtccggcgtcgcgccgatgatcatctgagtgctttgtccggccggtgcgaaacgcggcgcgctttgataacggacaagctcggccgagctttccgcgatagcgctgcggataaagcccatgggcctgagaatggaattttttgttttgtcaggcgcgagcttttccaggctttgatggcttggaagctcaatgttgatgctcatgcggtcggcgagcaggccgagcctgcggatgagcgcgtcgtccgcgccgggaattgccttgacatgtatatagccgccgaaccggtattcgccgcgcagcagcgagagcgtttcaatcagccgttcacaggtatagtcgggatttttgaggataccagacgaaaggaacagcccttcaatatagttgcggcggtagaactggatcgtcagctgtgcaagctcacgcggggaaaaagcagccctgcgcgtatcattgctgcgccggttcacacagtatttgcagtcataaatacatgcgtttgtcatgaggaccttcagcagtgaaatacagcgcccatccgccgcaaagctgtggcagagtccggccgtgacacagcttccaataccgccgcgcggcgcggcgcgcgatacgccggacgatgtgcaggccgcgtcgtatttggccgcgtccgacaggatctccagcttctccatcaggtccacatgtatgcctccttttgtagaacatatgttcttttttaggatatcatggagcaaggttcttgtcaagcctgtaccggcggctgttttttctgcgccaaaacgatacaattggtttacagcgcgaaaatttggtaatataatagtaaattaggattgtatgccgggaaaagccagcccaaatggcggctttcaggctggtggctgtttgaaaaatcagaatttgcgtctttttctacaaacagcggcgaatgctgtgttaaaaagcctcggaatccgaaaggattcctgcgttttttgctttgtattcgcctgctgtttgcgaaaaatccggcaattcctatatttttcaaacaagctccaaagacaataaaaaggggttaaggacatgaagcagtatcaaattgacaaggaacaatttatcagtgatcttcaggggttgctgcgcattaaaagcgtccgcttcgactgtgggcctgaaacagaaaaggcgccgcttggacagggcatctatgacgcgatcgaatatatgctggagcttgggcgcaggtttggattccgcacaaaaaatgtggacggctactgcggctggattgaaatgggcgagggcgaccgtatggtcggcatcatcgcgcatgtcgataccgttcccgtggaatccgagggatggatcgcgccgccgtttgacggcacggtgatcgacggccgtatctatgggcgcggcacctccgacgacaagggtccggccatggttgcgctttatgccatgaaggctgtcgcggacagcggcgttaagctcgataagcgtgtgcgcctgattcttggcggtgatgaggaggccggcgagtggagctgtatgaagcggtaccgccagacagaggagctgccctcctgcgcgtttacacccgacgcggagtaccccacaacatacgctgaaaaagggattctccatgtgcgtatttcggcggcgcttgacgcgcaggtcaagccaattagcctgatctgtgaaaacgcatacaatgtcgtgccggcgtttgcaagcgcggtagtcgacggcgttcaatatgaggcgcagggcaaagcagcgcatgccatggcgcctgagcttggtgtgaacgcgcttctggggctgtgcggccagcttcgtgaaaaaggagttgaccatccgtttatcaagctttgcgggatagcgaatgcggaaggcttcgggatcgcattttcggatgaaccgtcggggaaactgacgatcaatccgtcgattgccaaagtggatgcgcagtcggccgagcttcgctgcgatatccgcattcccgtcacatttacagataagcaggttgtcgaggcgatcgcagagaaggtcgcgccgcttggattcacggtggaaaacgagtatttccagccgccgctttatgtagaaaaggattcgccgcttgttgcgacgcttcagcgcgtataccgggactgcacaggccgcgaggacgagcctgtatcaactggcggcggcacctatgcgcgcgcgtttgaaaacgcggtggcgttcggcgcgctttttccggacgaggaagtcacttatcataagacaaatgaaaattggaacgtcgaaaatatttggaaaaatcaccaaattatttcgaatgcaattgtcgcgctttaacaatgtttttgtttatttcgctaatgcattgctgcaatgctgcgcaattcctacagaaaaattccgaataatcatacttttccgacaaaaatggatattttattccaattgcgttggaagttacggaaaattgtggtatactgttaccgttgcaaatacaactgaccttgggcagcggtacggggaagcgccgtcttgggttatgttggcgctgtatgcggcgtgcaaaagggaaaagaaaaaggaagtggttgtttaatggaggagaagtccagcttcaagccgttcataccggcggagaaaattgttcccgaatttacggcgacatcgattgtaatcggtgtgattttggctgtgctgttcggcggcgcaaacgcctatctgggcctgcgtgtcggtatgacggtttcagcctcgattcccgcggctgttatctcaatgggaattatccgcgtcattctgcaccgcgaatcgattctggaaaataatatggttcaaacgatcggttccgccggtgaatcggtcgcggcgggcgcgatttttacattgcccgccatgttcatgtggatgaaggaatggggacagggcgcgccctccctcattgagatcgctttgatcgctctttgcggcggcgtcctcggcgttttgtttatggtgccgctgcgttcggcgctgattgtaaaggagcacggcgtgcttccctatccggaaggaaccgcctgcgccgaagtactgcttgccggtgaagaaggcggcgccaaagccggcaccgtgtttgccggcttgggaattgccgcgctgtataagttcattgcggacgggctgaagatcttcccgagcgaggtacactatgaagtgaccgcatataaaggctccggcatcggcatggatatcctgcccgcactggctggcgttggttatatctgcggaccgcgtatttcgtcctacatgctggcaggcggcgttacaagctggtttgtgctcatgccgctgatcgctctgtttggcattgatactgttctgttccctggagccgtgccgattgccgagatggattctttcgccatttggacaaattatatcaaatacatcggcgccggtgcggttgccgcgggcggcattatgagcctgatcaaatccctgccgctgattgtgcgcacctttgcacaggccatgggcagttatcgcaacaagaatgaatccagcgggcttcggacggaacaggatatgaatatggggattattctgattctgatcgttattacgattgtattcatctggctgtttccgccgattccggtcacattgatcggcgcggcctgtatcgcgatctttggtttcttttttgcaacggtatcgtcacggcttgttggcttggtcggctcatccaacaatccggtttccggcatggcgatcgccacgcttctcatttcaaccatcctgctcaaatcgacaggatcgtccggccagagcggtatgatgggcgcaatcgcgattggttctgtcatctgcatcatcgcggccatcgcgggcgatacgtctcaggatctcaaaaccggctacattgtcggcgccacgccgcgcaagcagcagtacggcgagctggtcggcgttgtcgcctctgcgattgcaatcggcggcgtgctctatctgcttgacagtgcatggggctatggttctacgatgctgcccgcgccgcaggccatgctgatgaagatggtcgttgagggcgttatggaggggaatctgccttggacacttgtctttgtaggcgttggcatcggcatcgctgttgaaatccttggaattcccgtactgccgtttgcagtcggcctttatttgccgatccacttgtccacaccgatcatggtcggcggcctgatccgtctctggttcgagaagcgtaagtttaaaagcgaaaaggcgcgtaaagcgacgatcgattcgggcgttttgtatatgtccggcatgatcgcaggcgaggggcttgtcggtatcctgctggcggtatttgcggtcatccctgtaaagaagcttatggatggcacgacgattaacttgggcaatgtaatcgatctttctgcgcgcggtatttcaattggacagattggcggtttggtcgtctttgcgctgcttctgctcacggttctcaagtttacgctctggcgcaaatccgaggaaaaataagaaaatgcaatagacgtcaggacggacgccgggtctgggacccggcgtccgctttcagtggaggtggagcgattgacaaagaaaacaagacgaatgacaaaaaattatctggattatatcccggtcaaaaatccggatatgccctggcggcaatccgacagcgggattgtgacggtgacggttacaaatactggtttttacaattggatcgcacagaaatttttccacaggccgcgacagagctacatcgatctggatcaatatggcagctttgtctggctgttgattgacggcgaacgcagtgtgtttgatatttccggggaagtggggctgcaatttgggaaaaaggcagatccgctgcttgaccggctggtaaagttttttgaaattctgaaggggcatggctttatctcctggaaggaaggtgcgcatgagcacgtttgaaatcattctttgggtgcttgcgtttgcggttgtaaccatgatcatctatggatggggccttgtcaaaagcagccgccagcaggacgatttgcttgcaatactttatcgtaaaggggaggccgcgatccgcagggcgcttaaaaagaaaggtcccatgacgcgcgcacagcttgaggaggggcttgccggcatccgtgcctccctgttttatacgaaaaaccgtgcggtggtccgtgatgcgcatacatttgccggacaactgcttgagtcaatgacgcaaagaggcgaattgcttctggacaatggaacataccggctcaacccggatagaaaaaagcggtgagaaacagttggtttctcaccgctttttaagattatgcaattctctgcgccagcagcttgccgatcagcacacccagaacacaaagcagaacgctgatgcatgcatacaaaataccaagggcgtgacgcttttgctcgaacagcgtcacagtttccagcgaaaaggtggagaaggttgtaaaaccgccgcaaacacctgtttttaaaaacaaaataagtccgaaggggatgttcggttgatgttccgccaagccggtaacgaaaccgataacgaccgcgccaaacagattgatcaacagtgtggcgacaggaaaggggcctggaaacggaatcaagctgaacagataccggcagatcgctccaagcgctcctccggcgccaaccgccaaacaggtctgcatatccgttcctccctaaaaataatttcttttatcatagcatagagccgttcaattgtcacgcttaatcaatcgttccagtcctgtagcattcccgcagccttgcgaataggctaatagggggccatccacgaaggcccggaaaacctacacagatttggagaagataacatgtatgaatcaattatcccgctcaaccgcgtgcctgaaggagctattgcgcgtgtgaccgggctttttacaaccggagcgatgcgtcgcaggctccaggatatcggcctgattgaggggacggatatcgagtgccttcaaaaaagtccagccggcgatccgatcgcctattacatcaggggcgcggtgatcgcgctgcgttcagtggattcaggaaacatattggtacgctgtaatcaggctgtttaacaaattgtaaccaccatcagatataaggggcgattataaatgggtttgacatccgaatccacgggaaagcgggcattggatgaggtattttccgttgtacgcggcgatggcgatacggttatagcgttggcgggcaatccgaacgtgggaaaaagcacagtgtttaatcaactgaccggcttaaagcagcataccggaaactggcccggcaaaaccgtaacgaacgcgcaggggcgctgcctgtaccatcaccgatcttttgtactggtcgatatacccggtacatattcgttgatggcgcattccgcagaggaggaggttgcacgcgattttatctgttttggcggggcggacgcggttattgtggtctgtgacgcgacttgcctggaacgcaatatgaatctggtgctgcaagccttggagattacaggccgcgctgtcgtttgcgtcaatttaatggatgaagcgcgccgcaagcgaatccatatcgattttaagttgttggaaaagcggctgggcgtaccggttgttccggtgagcgcgcgcgcaggggaagggttggatacacttttagaggcagccggccgtgccgctgatcttgagaatgcgtccgcacgccggattcgttacccacaggcggttgaacaggcattggaacagataacaccgctgcttgataaccacaacggcttgcccgcccgctggattgccctgcggttgttatgcgatgatacgccattgatcagcgcgctgcgtcaaagcggtgccgatccacttgcggatgaatcggtttcagccgtgctgtgtcaggcgcgcgaggggctggaagccgccggcgtgactgcggaaaagcttggcgatatgatcgtgtcctccattgtattacatgcggaggaagtttgttccgatgcgattcgcttcgaccgggtcgattataacagctttgaccgccgtcttgaccgacttttgacaagccgggccacaggcattccagcaatgctgttgctgcttgcggttgttttctggctgacgattgtaggcgcaaatcaaccgtcgcggttgttgtcacaggcgctgtttggcttgcagccgcacctgactgctttttttgagatgtggaatgccccagtatggttaacgggcgcgctggtagatggtgtttaccgtgtgctggcctgggttgtcagcgtgatgctgccgccgatggcgatctttttcccactgtttacgttgctggaggattctggatatttgccgcgtgttgcttttaatctcgaccggggatttcaaaagtgcagcgcctgcggcaaacaagcgttgaccatgtgtatgggatttggctgcaatgcagcaggcgtcactggctgccggatcatcgattcgccgcgtgaacgcctgattgcgatcataacaaacaattttgtcccctgcaacgggcggttgcccactcccagggagcggaaacattcattgactgtgagagataacagagcgttccaagctgcatgtctggaacgctctattgttttaggcttgctgaaggtcaatcgttcagggggtggatgtgatgtccctggacggattcccgtgcaggctgcccagagaaaaaatgatcagcgcggcccatatgaaaccatatccagcaagataggccgcggaaaaatgttcatgaaagacagccagcgcgatcagcaatgagatgaaggaggtaatatattgcaaaaatccggccagccccaggggaagaacctgaaggctttttgcatacagcacgagcggaaggcccgtcacgataccgatggccggcaccagccaaagccgggccgccggcagcaaagccagggcgcctgcgccctgtatctcggaaacaagtacaaagggcaggcagaacggcagcacggccgcgccttccacaaacagcgccacaagcgcatccaggccgagcgcctttttgcaggtgctgtagatgccgaaggtaccggctaaaaacagtgcgatccatggaatctgtccatagtataccgtcatccacagaacgccggctcccgccacaaaaatgcccgccgcctgaacccggttgggatgctcatgaaagaacaggcaggcggccagacagcaggtaagtgaattgagaaaggaacccatggtggaatcaagcgtccggccgctgttgacagcgatgattcctaaaagccagttagcggcgatcatccatccggcggcggcgcttttgaacaggcaacgctgattacgcagcaaagcccgtacctgcggccatcggcccgttatggcgatgagaacgccggaaaacagcgtggcccagaggatacggctggaaagaatgtacagcgggggcaatcctgccagggcacgccagaataagggcaggcacccccatacaacggtgctgccgaacgcgcaggccaacgcttttttcacagttccgcctccacaggcacaatactgggaggttttcccagatactgcgccaatacggttgtcagcacgcgatgatcctccagatgcggcaaacctgatatacagtatactccgacgattccctggccgcggatgcggatcggaaagccgccgccgcacagggcataacggtctccgtcacactgccaaccggttggcggatgctgcgaaagcgcctgctccacagcggcagccagcgaggaaacgccagttttgcataccgtgttgtatttcttggccatccaaaatgcattctttgcgccggtacccggcataaaatagcgcaggatgtcaaatccatccaaaacagcctgcaaggcgatgggcctggattccttctgcgccgcttcgatcaataacgcggcgattccccaggcgtccgccgcgtcaaatgcttcaaacacaagctcccgctcctgcgcgcgcagcacacgcaatgtcccgtccgtatacatacggcgtcaccaggcgagaaaaccgccgtccaccggcagcaggattccggtcacataaccggcttcctcagaggccagaaagacgcttgcggcgcgcagatcgcgttcaacgccccaccgccctacgggtatacgcgccagcagatggccgctgcgggacaaatcggcgcagtagtccttattcatgtcggtattcatatagcctggcgcaatacagttgactgtaataccgtaaggcgcccaatcgttggacatggctttgctcatctgtacaacgccgccttttgcggctgcgtaacccagggacatacggccgccgatgacgctcaggagggaagccatattgatgatgcggccgtacttttgttccatcataaccctggcggcaagctggcttagaaggaacactgcgtcgtagttaattttacggatgctgtcccaatcctcaagcggaaagtcctgtgatttatgattacggttgatgcccgcgttgttgaacaggatgtccagccgcccgcccagcagcgtcagagcttcgtcaaatccccggcgcaggctttcgcggccggacaggtcgcaggcaacgccgtaaacaggcgcgccgccgtccgcggcgatctccaatgccgcctgtttgcaggcgtttgccgtagagatgacaacgacctccgcgccctgctcgtgataagcttcggcaatggcgcggccgagtccccggttgccgccggtgacgattgctttgcggccggtaagatcaaacatcataagatattcctcttttctttttgggccggatacagcggcaaaatgacaccgccgcatccggccgcctgttttttactgatcgttttcgggagcgaccacccacttgccgttttctaccctgataaccgtcataccgcggtttaccatgcggttttcatcaaaggtggcataacctgtttcgccgtcccactccttgattttgagcagctcgctgtaaagggacgcgcggtcgccggcgccgtttttcagggccgcttcgatcatggcgagcgcctcgtaggcattggttgcgaaatagttggggctttcattgtacagagaacggtatttttccgtaaaggcggcgatgcgcccgtccgggttgtccgcgaagaagatcgtcatggaataaacgccctcgcccgcatcgcccgccagcttcaggaagtcgtccgaatagatcatgccgctggaaacccacttcacaccgcccaaatcaatctgttttgcctgctgaagcatggtgcccatgtcgttgtagcttgtgacgcatataatcagttcaggcgcggcggacttcagttttgtaaggatggaggagaaatcgctcacctgcccttgcacatagctttctgtcagcacaacctcaccgcccatcgcgggaatctgttcgttgagaatctcgcttaacacgataccggaatcgttttcaaggtgcacgatcgcgattttcttcgcaccgatttgtttacagccacatccgccagccatgtatattccacatcgtttgagttttgcagcctgaacaggtggtcgttggccgttgtgatatcgggatgcccggcagtgggggccatctgcaccataccggcctcctgatagatgggggcgccggccaggacgcaggtgctgttgtagctgccgatttcagcgatgtatttggaatcggacgttaccatctgcgcgatgttcgacgcttcctttggcgtgctcttgtcgtcaaaatagtcgatctggatcatcttgccgttgatcccgccggatgcgttgatctcattcattttcatatcgagcgcctttttgaagaagtttccgtactgggcgtcgtcgcctgtgaacggcgcgccgcatgctatgtaatatgtgccgccctctgtcccggacgcgcccgcggcggtattggaggaagccgcggcgctgccggcggaggcgctgccggcgcccgctgtttcggaggcgctgctgccgcagccagccagcagcgcgcaggctgttgccaatgccattgccaaacaaattgctcttttcataatctgctcctttcaaaatcaggcgcgtggaagcgccgaattgaccgttcaggcgttgccgccaagataggacgcatagacctgctcgttgttcaaaaggtccgcgcccgttccttccagcgtaattttcccgttctccagaacatagccgtaatcggcgatggacagcgcgccaaaggcgttctgttcgatcagcaggatggtgacgccctgctttttgatctcggtgatcagccggaagatcgtttctgtcagaataggcgaaagcccaagggacggttcgtcgagcatcagcatatcgggattgctcatcagcgcccggccgatggcaagcatctgctgttcgccgccggacagggtgcccgcctgctggctgatgcgttctttaaggatagggaacagctcgaacgcgcgttcaaaggaggctgccagcgtgtcctttttgcgggtgtagccgcccatcagcaaattttcctggatggtcattctggggaaaatctgccggccttccggggacaatgtaacgccgcggcacacgattttgttcgcgggcaggccgcacagatcctgcccgttgtaaaggacctgcccgctgcgcgggcgcacggtgcctgcgatggacttgagcagtgtggattttcccgcgccgttggagccgatcaaagctacaatatttccctttttgaccttcatatccacatcccacagcgcatggaggcgcccgtaaaatgtgttcagcttactgatctccagcagcatcgcgccgcacacctcccttgccgatataggctgtgataacctccgggttcttttgcacctcgggcggtgtcccctcggcgattttgatgccgtggtcaatgacgtttacatagtccgagatccccattacaagacgcaggtcgtgttcaatcagcacaatggtgaaccccttttgggtaaggctttttatatatgcgcttaattcccgggtttcctgcgggtttaaacccgcggcgggttcgtccaggaacagcagcttcggatcgctcatcagggcgcgggcaatctcaaggaccttttgctttccataagggaggtttacgcacagctcgttttcgtaccgtaaaagatggatttcatcgagggccgcgcgcgccttgtccaacgcttcggcttctgttcgctttttccttgaagtattaaacaggccgtcccacaaattctgttccagacggcactgatagccgatcagcacattttccaacacgctcatctgggcatatagccggatattctggaaggtgcgggcgatgccgcagccgatgaattcgtatgcttttttgccaaccatctccacgccgtccagcttaatgctgccggcgtccggctgataaaagcccgtgagcatgttaaagatcgtcgttttccccgctccattgggaccgatgacgctgacaattttgcccttgggtacgctgaaggaaacatcctgcaccgctttaaggccgccaaaggagattgacagccccttaacttccaacaggtccattttcatcgctcctttcagcattcctttttaaaagtggcggcggttttcagcgaacgtttcacagcgccccagtcggtgattttcagcagcatcatggcgacaagcacgacgccgtatacaagcatgcggtagtcggagaatgagcgcagcgcctcgggcagcaccgtcaacagcacggctgcgatgatagagccgttcatattgcccatgccgccgagaacaaccatactcaggatcacagtcgattcatcgctgataaagcttgtaggatcgataaattccatatagcttgcatacagcgcgccggcgatgccggcaatgccggtggaaataacaaaagcaatcaccttatggcggtaaacattgatgcccatggattccgaggagatttcatcgtcgcgcagcgccttgaggttgcgcccgaacttggagcggatcaggttgcgcagggcgatatacaccacaatggcaatgatgatgaccagatagagaaatgccgcgctgcttttgatggtgtagccgaacagctctggcttggggatgttgaggatccccataggcccgcgcgtcacatccgtccagtttaagaggatcaaacggatgatctcggcaaagctcatggtgaggatcgccagatatccgccggagagcttgagcgtggggatggcaatcaacaggccgaaaaacatggacgcaagaaacgccgccaaaatccccaaccatacgggcacgcccaaatttacgcacagcagtgccgaggtgtaagcgccaatcccataaaaagcgatatgtccaagggatatctgcccggcgacgccggcgattaaattcagcgacatagccaaaatggcatacaatacgctgatgacgcagacgcggtatacatattggctcaaccccatcatggggaacagaaagagcgcggccagcatcagcccggccagggcggcatgaagtttggcaggaagcgttttcagttttttcatcatatacacctacaccttcttttgtaccggcttgcccagaaggccgcaggggcggaagatcagcacaatgaccaatacgacgaaagcggcgatgtcgcgcatgctcgaactgatatacccggcggtaaacgtctcgacgacgccgatcaaaaggccgcccaaaacagcgccgcgcagctcgccgatgccgccgagcaccgttgccgcaaaggttttgttgccggtcgtcacaccgattgaaagattgacgctgcgaaaaatcatacaggcgaaaatacccgatactgcggcgagcacagcgccgaagaaaaatgtaaggcccacgacgcggtccacgggaatccccatcagttccgtagcctcggaattctgtgcggtggcgcgcatcgccatgccggttttcgaccgcttgatgaataacgtcaggcccgccatcaacagtatggacatcgcaataacaaatagctggatataggaaatattggcggtggcaaccgtgatgtatttgccgtcaaacagcgtgggaaactgccgcgtctcgctgccgagaaaaagcagcatgacgttctggatgacgatggacacgccgatggtacagatcagtgccgtaaacttgggcaggttctttttgcgcagcggccgcagcgtgtaccgttcaatcagatatccaagacagcccgtcagcagaatggacaggaaaaaagcaggcaaaaatgggatttggcacaggctcgcgaacacataaaacaggtacgcgcccaccatatacatcgtgccgtgggtgaaattgataagctccagtacagcataaaccagggaatatccgattgccgttaaagcatacaggctgccgagcgcaatgccgttgactaattgctgtgtgaagaattccatattcgtactcctttcacgcgggcaggcgccggtcagcgcctgtatgtacacgtggagcgcacagcctgcgcgatgcgttcaagggcgatgtccgtcggcagcgtgcagtcggcgcccaacaaaatatttttggtcccggtttcatccagtacgttgtgtacggcaagctcgatctgatcaggcgaaccgtcgaccagtacgcccgcccggtcgtccaatccgcccagcaggacgcgctgtgcgcccaaaagcgcccgtccttcgttcagcgtgggattcccttcgtggacgccccagttgatcacctttgcagggtacccctgataacgcgcgagattgagatggtctttacacatatgaaggacgttaaaacaggggacaatccgattgtacttttggagcagcgccatttcatatggtttgaagaacgtttcaaactccccgtccgtcatcatggccgtttcgcccccgagggaagcgaaatacaagccgtctgcgcccgcttcgatacaggcgccgcagaggacgtcaagataaccggcgatgacctgcatgccgtggcggaaggcatccgggttctcccgcaggcagcgcgtaacagccaatttgtcgttgtcgtacaattcaccgccgccaagatagtgaaaagccgatgcgaccatgccgtggatggtagccaatacgaccgcctggccgtttacctcctcacagacgcggcgtacaagctccacctgccgcacaataaagggcgcgtcgcgtgggatggggttcagtttgccccagtcggcagcagtggacagcgcgggattatttggaaggctgttttcattcatcaccttgcataaatccgtaccgcttttttcaaaaaaatcgagatgcatctgtacagacgcttcgcccgcctcataccctgcgggaaaatgcagccaaaaaccgcagggtaccctgtcgggcacattgccggacaccgccgccaggacccgttcacgcttgttcatgaaaatcccccttcgctcttataatcatgttattaaaaatattcttaatattatcaggacgcctaaatgatagcatcccatgaaatacttgtcaataaaatctggcgtcatttctgaaattttggcaaatagaacgaattttatttaagaaaaaagtcaaaatgacaattttaaaggcggcgagcatatgcgtaaacggttagtcgttactggagcagacgcgcaatggaagcgttatcagacattgacctataatctttcagaatattgcgccaggcattgacaggaggcgggttgcagcctataatagattttaacatgttattaataatatcaaagaaccattcagcaggacgaggtcctcaaatagacccggaaccgaaagtagggaggaatctgtgccgtggcggaatctaccatcaagtcgcgagtatataacgccatctggaacgacatcatcgatggcgcgtatgactgggattatgtttttaatgaaaaaagccttgtggaaaaatacggcgtcagcaaatcgcctgtgcgcgacgcgctgctggagctgtgtaaggacaatgtgctgcgcagcattccgcgctacggttacgagatcgttcgcatccccgaaaagcagcttcgcgagatgatcgatatgcgcgtgctgatcgaaacgaccagcctgcgccagtgtttttctttgcttggacgcgctgaatttgatacgctgcgggaatacaatctgcgcagccacctcctgctgctggataaaggctcgacagcgcgtgatctgtgggacgacaacatgcagttccaccggcggttatactccttttcaaacaatgaatttggtatgacgattctggaacgatgcatgaagatgcagacgatggcttacgtgcagttgtatcgcttcacgcaggatacgcataaaattatgaccagcacttcgcatgagcggatcgagcagctcatagtggatggagattgcgagggtgcgatccgcgcgctgcaaaacgacatccgctccatacgcgcagcgcaaaatgccagggaggaggggtttgattgcgtaccctggagctgaatgccggcaaagacagcctgcggctttcgcgtcttgtatttggaacgggcagcgtgggcggttcgatcgcctttgatgaagccgccgatttgcttgatctgtaccgtgcggagggcggctgctgtatcgatacggcgcgcatgtacggaaaaggggccagtgaagaagcgatcggccgctatattgcgctgcgtaattgccgcagtgaggtggcgttgtctacgaagggcggatttccgtcagggaacaatatgcatcattcccgcatccggcccgctgcgcttcgaagcgatctggaagccagcctgcgcgctttgggtacggattatgttgatctttatttcctgcaccgcgacgatcccgagtatcccgtagaggtattgatgccctttttggacagccttgtcagagaagggaaggtgcgctttctgggcgcgtcaaattggacggccgcccgtatcgccggggcgaaccggttcgcggccgccaatggcttgactccgtttaccatcagccagatccaatggagccttgccgcggcgacgcccgcaatgtgggaggacgataccatcgtatgtatggacaatacggaagaggcattttacaggcaggcatgtatgcccgtcatggcgtttacgccgctggcgcgcggctttttttcaaaggcaattgcagagggggtcgacagcccggcgctggaaagatacgctgcctttaaaacgccgctgaatcttgcccgtgtggagcgtgtacgcgcgctgtgtgatcgatacaatgccacgccggcacagatctgccatgcatttctgacgagcggctcgctggccggcttggcggtgttgggtgcgaaaaaccgcgtccaactgacggattccctgaccggagccgatttgacgctcacagctcaggacctggaatttttgtgtgcaccggatgtgctgtgaacaaaaaacaggcatggccgcgcgtttacagcatacgggccatacctgctaatgatcggttgacagcttttgccggatcagggagacgacttcgcattgcttttgtggggaaagacgggacgcctccaattggcgttcaatgatctttatatgaagctgattgagaaaatccgcggcgcttcgttcatccggtgggggaatcatgtggacccggatatttctaatttggttttgtttcatctcgccacccccgcttgatacagaatatgcggcgcatagattgtcctatacaaaaaaacgggacagcttatgcggtcccgaattttctgcggttcatgccggcgtcctgttaaaccgatccatttataacattatgtgtatcggtgtttcaatcaaacttctgtggggaaggtttcaaattgagcgatggtcccggctgatagacaagccaattgacagaaaggaaagtggcgatgaatccaacaggtattgtaattggtattatagcatttctttcaatcggtatttttcatccggttgtgatcaaggcggaatactatttttccaagaatatttggccggtttttggcgttgcggggctgttgtttctggcgttatccctgtttatgaagcatcctatcccaagcgcgggatgtgcggttatcggtatgacctgctgctggagcatcaaggaactgtttgatcaggagaagcgggttcaaaaaggatggttcccgcaaaatccaaaaagaaagcgccgctgattgcgtttttatagccgtatccatttgtgaagcaggcgtccgggtctaggctcggatgtctgcttcatatttttatataaaatccaaagttggggaggcggtttgcatccggatttttatttacagccgcaagtcggtctatacgggaaagggagaatcgattgaaaaccaggttgaattatgccgccgctatattgctgaccggctcaacgatggcagcctggctgaaattactgtctatgaggatgagggcttttccgggaaaaatcttgtccggccgcagtttcagaagatgatggccgattcaaacagacaaaaaccggattacatcgtctgttaccgcttggatcgcatcagccgcagcgttggggattttgcgccgttggtggaggagctgattgcacgcgatattggctttatctgtatcaaagaacagtttgatacctcgacgccgatgggaaaagcgatgatgtatattgccagcgtatttgcgcagttggaacgcgagacaatcgctgaacgggtgcgcgacaatatgtttttgctcgcgcgttccggccgctggcttggcggcgtgccgcccaccggttttctttcaaaacaggtggaggaatgcacacccgacggaagaaaaaagaaatcccatcacttaacccccgaaccgtcagaaatcagtacaatccggctgatgtttcaaaaatatctggagctgcgatccctgcgcggcgtttccaaatatttgatgtgcgccggcatccgtaaccgcagcggcgcgccttattcattacctggtatcaaagatctgctgcgcaatccggtttactgtacagcggatatcgccgcgcgggattattttattgccagcggtgcacaggtttgcttttttgaggaagaatgctcagaaggacgcggcctgcttacatataataagcgccaatatgcacacaagggttgttcccggctggaaaaatcccagtggattgtcgcaatcggcaggcatcccggaatcgtcagcagcgccgattggatcgaagtgcagaggcttctggaggaaaaatctgaaaaaaatcgtctgaaatcggcgcagagctacaacaactacgcgctcttatcaggacaaatcttctgtgcaaaatgcggcgcacggatgtttgcaaaacgccgcagcaacagtgaaaccttattcgattacatctgtaaaaacaggctgcgtgccggtgagctttgtaccggccgtaacctgaatggttatcgagccgatcagcttatatatgattatctgatacaatctgtgcgggaagacaaaggtatctatcaattactagagcgcttggaaagaacgatccgggggcagctattgccaaacgcagcggcgagtttggatgcacagattgaaaaaacgcagcatgagatggatgcactgctaactatcctgacatcagccgctggaaacgaagcggtggttcgccaggcgaataacaggataacacggctggataaggagttaaaaatgctgtgtgcttttaaacaacaggaaaaacaggccgcggaaggcgaggggatagacacggggcagaaggagcgcctggccaatatgcttgcggattttcagcaatgcttttcattggcaactatccaggataagcgcgattttatacggttttttataaaagaattgaaatgggatgggacggatctccatatttttctctatgaacgcgaagggatcgaatttatggatacctctgcataaaatgtttccaattcccgggagccgcattcccaacgctgattgcaattatcacgatgttctttattggaggagcagccggtatatttgcatcactgacatccacattgtttttgaccggtgtgatcatattgggcgtcctgatgacgttttttgtgtcggcgtttctttctaaaacggtcctcaagggaatcccatcttcgtttacactcgaattgccgccctaccggcgtccgcaggttgggcgggtgattatacggtcaatttttgacaggactctgtttgtgcttgggcgagcggtggcggttgcagcgccggccggactgattatctggctgctggcaaaccttcagataggcggcgttagcctgttggcgcactgcgcggcgtttctcgatccgtttgcacaattgcttgggcttgacggcgttatcttgatggcgtttattcttggattccctgcgaatgaaatcgtcgtacccatcatgattatgacgtatctttccactggcagcatccaggaatttgataatctgacgcagcttaaaacactgttggttgacaatggctggacctggctgaccgccgtctgtacgatgctgttttccctgatgcattggccctgttcgacaacctgcctgaccatccgtaaggagacgcagagttggaaatggactatggtatcgatcctaattccgactataatcggtatgactgtctgttttctcgtggcaagtgcggcgcgtcttacgggccttgtttactaaaagagcgggccgctctgacttgcctcctaataagaaaacataagcaagtccagtaaaatcaatgtagcgaaaatttaaacaaagcacccgcgcataatgctttcaaaaagcaattatgcacgggtgttttctatggcgctatcttttcacaaatgacaatgctgcttcgggatatacaacaagaggcagagaatcgacatcaaaccggcacttttgagcagacaaacacgtttccgttccactgttgctctatccgttttttcttttggttaacctagttccatccaaagtcttttcagtcgagcaactggattaaaaggcccaaaataatactgcattttttctatagcatcgaaaataaacacatcattacaggaaatctttttttagattttctgtaatgatgtgccattgtatgagacggcggttattcagttttttgtatataaaaagttaatggtgtctgtgtctatcgtaataacttctatcatggtcatcatgaccatgactccatcgactccatgcatttctgtcattgagctcatcaatcataggttccatttcccagtaagtttgatcgttttcatactctaattcagcatattgagatataaactctgttcggtttagctgaccagaatggtattgaaattccattatatcttgttgctcgtctatcttatcatgttgttgacgtaatgtataaaaacgatctcttaattcttggtctgaaagatttgttacgtcaacagaatccgaaacattttctggtttccagccggaggtaatcaattcctgccatagttgttcactggttagatgtaaatcatcaatggtttcttccagcttctctctttgtgaataataattttccccacttatagttccgtcccttttctggtgctttaaaaggtctttgtcaagtttataagattctctttcagcctttatagcatagtattcgttcactaattcggcaatttcatcattttgcagttgcggtttgatattctccgtattttcagtaaccttatcatcttgcagttgttgctgaatatctttcatatttgtagatatagcggtatcactaatagcatatgacttgcttatatctaaagagggcatctgtaaagcttcgtttggcaaatttgtattggaagcacctgtggaaacattcgaacatccccaaaataaggtaccgcaaacaacgcacaaaactcctgcacataatcttgttttaataaatttacgcatagctaaaattcctttcaattatagaatgtgcatggatataccatagacaacagcaatatcttttgctcttactttacaatttgtattcaacaaacaagttcaatccctgcaaataaaaataggactatatggattgctgttcaaatcaagtacagcaaaccatatagccctaaagcaaatttagaataacatagaatttgtgttttgtcaactcacaaaatttaattctcaaactcttttttcccaaatgagagggatttactcctcgagcattttcttgcaggacagctcgttgagccactgttcaagattgcagagcagctcctggaacagcgcctggtcagataggtcgtcgatatcctccagctttaaaaatgcggcgttatttgaatggcggccgtcaatttcattgagacatgacaaaatgccgtattccgagccgccgatcccaataaactgccagtaaattggaaaacgtgatgttttaattaaaatttcctcgatcgcccaatccgccgacagatgaccgtccgttacaaacagcaccataaccggcgcacgcaggccgccatagatcatcatgatgtcgcgcatggcttcgggttcgttgttgaattgatagttgagcatactcatccatcgctcaaagccgcccatctccgcaaaggtataatcgcgcacattgtccattgtgaccgcgccgaattgacggctcttggctgcaaacgcccaaaaatccatcgctgcggcgtcggaaagtgtggatgcatatgtaaagaatttgtccacaacgcgctgcatacgcccattgcggtactgatcgaacatagagccggagatgtcggagcacatgacaacctgtacagaccgttcggcggcgccgggatagcgcgccagcatgagaaacatattcttataaagctcagacaggtaagctgtgtcgccgcggcattgacgcgcaagattatccatacgcgtgcagacttcagcgggcagagagcgcaccacattttgaaaggcagcgtttgcgggccggcgcggcgcgcccgcccggataccgcccgccgggcgggcgggcggcgcgggcgcatcagccgcgccggcagggaccggcgcagccgccggctgcgccggcgtgggcgaagctacagacccgccgtagctttcaatcaaggcttttaaaccgccgttgaagccgcgtccgaccgcacagaagcgccagtcgtcgcctttgcggtaaatctcgcagataacgatggcgcgttcaccggaaaattcagcgccggaataggaaaaacgcagcgtttcggtctgtcctgaaagcagacggacatatcctttttccagctcgcgcatcgtgcgtgtgccatcgatggagacggcaaaggacaatttggaaatctttgacggcagtttgctgagagaaagggtaaagcgttcagaaccggcagcagcgcccgcgctcaggcaaacggcctgttcaggcgattgcttttgattgtagaaaacaaaatactgttcatctgacaggcgtccggcgctgtcaagcccaaaacaggcggcgtcaagctccattggagctttgtgataaagctccagcacacagtcagctccgccgcaaagcccgctgatggattcacgctgtcccctcaacgcttcgatcattgttttcacgcctcctcagattgaggccgtatgaaaaaccggattggactccggcttttcacacaatgcctgaaatcggttatagcaaagcgttattccgcctttgccggaaagatcagcttgcggatggtgccgaccggcagaacgatcagtgaaagcaggatcacaacgccccattccttcagtgtgagcggcgcggtccgcagaatcgaaccgccgataaaggtcattaggacttggattgcgacgatcagccccatgatatacaaaaacattttattgccggagatattgtcgaatacattcagcttatccgtgcgcgcgttgaagccgttgagcatggcgctgaatacatagaaacagaagaaaccggtcatgaaatagatatcgctgccgttatagaccatcagaccatcctcacggaacagcgtcttgaagaatggaacctgcaggaagatcaggcttgccgccgtgagataaattccaacaacgatcagcgccgaccacatgtttttactgatgatcgattcgtcgcggcgcttgggtttttcattcatataacgcgccagaggcggctctccgccgagcgcgagcgcggcaagcgtatccatcacgatattgacccaaagcatctgcgtaacggaaagcggcgtgcccattccaatgaacggaccgatcagcgcaatcaaaacggcgctgatgttgatcgtaagctggaacactataaatttacggatattgttatagatggtgcggccatagagcaccgttttgacgagagaattaaaattgtcgtccaggatcgtgatttccgcggcctccttggaaacctcggtgccggaacccatcgcaaagccgacgtccgcttttttcagggcgggcgcgtcattgacgccgtcgccggtcatgccgaccaccagattcttttcctgggaaatacgcacaaggcggcttttatctgtcggaagggcgcgcgccaccacacgcaggcggggcaatacatttttcagctcgtcatcggaaagctttgccatatcgtcacttgtcatcgctacgtcgtctggcgaatcgatcagccccgcgtcacgcgcaattgcggcggcggtttcttttttatcgcctgtgaccataacgacctgaataccggcttttttagcggtatgaatcgcttcgaccgcttcaggacgcagctcgtcacggataccgacaaggccgacaaacgtcatatcctgtaaaagcgaatcgccgatgccgttgtcagaggtggcgaaagcaagcacgcgcatggctttttccgacaacgcggacatgcgcgcttcaaggcgggcgcggatttcatccgtcatcggatgcggctttaaatcctcgccgtaataggcggtgcagaagccgagcagtttttccggggcgcccttgataatagcgcggttaagcttgccgcgcagcacgcttgcggaatatttgttggagctgttgaacatcagcgagtcgctgcactccagcttgtaggtttcataggtgagcgttccgtctacgcccacaaattcatgcagagcgcgctcggtggcatttccgccggtcacctgaagatgtccgttttgaacaagcgcgatggcgttcgtattgccgcagatgttgatgagcagcatttcacggagctgttccggtatagattcgaacgactggtaatcgtttccttcgggggaggtaaaactgactacctgcaaggcgcccttggtgatggtgccggttttgtcggaaaacaggatattgaggctcccggccgtctccgcgccgtcgattttccggatcaaaatgttgtccttgagcagctttttcatgttaagccccgatacaagcgcgatcatcatcggcaggccctccggaacagccacgacgatgatgacgacggcaagcgttacagacgaaacaagatcgcgcagaatctgcatcacattggcggcggaaaaatacgtcgtcgcgcccggaagcagcgttggattaaaaaagatgcagttgatcataaaggcgattgcgatgagcgtaccgccgatatatccgaatttggaaattgcgtcggccaccttgcccagcttgaccttcagcggcgattcgcgctcctcgtcctccttgagttcctgcgcgagccggccgaactgcgatttgtctcccacgcatttgacctgcatgatggcctcgccgtttgtcacgacagagccgcgatagaccttgtgcttatccaaaaaatcgatctgttcggcgtcataggtgtagtcggcttcggcggccgtcttgctcgcttcctcgctttcgccgtttaagctcgcctgattgaccttgatgtcgccgtcgaccagaacgccgtcggcgcagatcttgtcgccggcctgcaaaagaacaaaatcaccggttacaatgtcgtcgatttgcagatcacagacctgtaccaaaccgtcgcggcggcggaacgctttgcagaggatttttgaatattcgtcctgcagcttttgaaaaagctggttgttggaatattcgctgtacgtggaaaccgttgtggccagtacgacggcgattgcgataccgaccgcttcaagccagtccccgacgccaaagatggcgaagaggatcgtgatgacgagcgcgacggttaaaatccgcacaagcgcgtcgccgcgaaacgtatcccacagttcgcgccagaaggatgtttgttccggaggcgtcagggcattgctgccaaactgttttcggctctgttccgcctgctcatccgtgagcgcattgatttcatgtcgattcagcatacatgatactccaatcatttatttgtcgccccgataggggatcatacaggttttgagaatccattcgaggatttcctcggaaccagcctgagcgggccgttcagaaaagaaaatcgggaaggcgcatggcagggaagcgagggcgctttctccaggcgcgaaggcgtggcggcataccttaagcatcggcaggtcgaaccaggaatcgccgaagccgattgcctcctgcccatcttcaagcgtccgcacacgtgcaaggacagcccctttgtcaattgcaagcggggagaggtacagctttttccgttcccggaacagctcccatccgcttttggcgagcgcctgagccagttgactgcacgctgcgccgtcaaaacgcccctcgtcgacgaaaaagacggccaggtactcgtaccgctttgacaggcactcgattcccgcaagcccgtccaggacctgtccagccgctccgttaagatcaagcggcagcgcccgcacggtccgcgcgacatgcgcggcccaatccatgtccagcactccatcccgatagaggtacagcccattttgcagcgccagataccggcagctcgcgtcgcggacaaatgaaacgcgcatggcctgctcatatccgcgcagcgtgttgatcaggcagactgcgtttttctgtatccgccgcagagccgccagcgcccccggcgtcatataggaaaacggctccccgagccggtgctccacagcagtgacaggcgcgccgccccgcagatgacgctctgtaaaaatcagcgtgtggtcaaggtctgtggagaagatcataggcgcccctcccgccggtccgcgatcagcccgcagcacaggtagggcatatcgggataaacgcagacggggacgcccttttcctgcgccaacagccggatgtgctcggtgtcgggatgcgcaggctcgcgcagcagaatgcggtccggcacacggcgcagcagcacgcgcgtcgtttcgccgatgctcggcttgatgcggttgatgtccgcaatgccgaacgccgcgccgatctgccggacagcctgcatcccgcgccaatcgggcggcggctgcggcgcgtccagggcgctggcggcagcggagatctcgctgtcgagacgggaaaaccacgaggacaccgtgtcaagataacgggccgtctgatcgatcgcggcaaattcatggtaaacgcgcgcgccgtgaaagtcctccggcccgatgatcgagcggttgtggacggaacggctgatcagaccgcagattgtgctgttgaggcagcaggacggattgataaagtcctcccgggtggcgtacagagagcagcagtgcgccgggtcggccaggacagccagcgtcggacgcagcgccgtgccgtttcgctcattgaagacgcggcaggactcctcaagctgcgtggtgatcatgccctttccggtccagccgtccacaaacacgatttcctgcccgggatgacgctttaaaatcaggcggatggcgttttcatcaaagcccttgccgcggatgatgctgacgccatagtgtaaaaagtcgcgtccgagcatacgcgcggcatagcgccgcatcagcacgccgcaggggacgccggcccgcaccagggaaacgagtacgggacgtttaaagcgcgcggcgatcagacgcgtcacaatccctgtgtacagcgcggcctgccgtgattttgtttgcatcaaatggctgaaaacacgcatgtaagcctcgctcggcacctgctcgacaggcagatcctccgaatagtggcggcctgcctggatttctcgctcgcgcagcgccgtgtcgcgttcctcaacaagcccggtgacatcctttaaaagcaaaatcacgtcgtcttgtgaaaagctgccgagcggcgcgggaagctccctgttcatagcatcaccaccgaaaccgatttgataccgcgcatagacagatattgtgtcaattgccgcgcgccgcgctcgataaacgcgccgcgttcagcgaacagatatgcgcgttcatacgcgccgtccgggacattgtaaagatagccggcggcgctgtagcaatcggccgggtcgaatcgcacaccggagacgatggccgatcccggcagcggaaataccggactttgcgtggtggagtggaatgctcccccgccgcagaagcctgcaatcagcgcgggcgcatagatcagctcgccggagccgagatacagcgtacgcggcgcgtccggcgcgccgattttgtccgcagccgtccggcaggcccgccgcagcgcggcaaggcgctcctgcgtcatcagccgccggccggttccaggcaggaaaatgcccggatccagcagcgtgggcgcgctgcccgcggcgcctgtcagatcggcgagcgcgggagccggcggcgcgccgttttcgatcgaaacgatgcggcttttaagcagggaaatcatttcgatttcgacgccgagccgctgttcgacagcccttcgctgttcgcccgagctgttgtcgagcagcgccagcagtgcgaagcgccggatgccgtatgcggcgtgcagccgttcaacgagacgaaaagctgtgtttccggtcgtgaattcgtcgtcgatcagcacggtccgccggcatccgcgcagaaaggcgtcgtccgggtcgaggtaaagcagatgcgtcctggcatgggaatgcgcctcgtcgaaggtgagcggcgtgccgcccgtctgttcaaagcgcgttgtactgatataagccgattcgcccgagaagcaatcggccaccgcctgcccaagaccggtcgccgtctcggcaaagccgatgaacagcgtgcgttcctgtgcgggcagaggggttcgggacgcttcaagacgtgcccaaagctctgcaaacggcgggtcggccgcgccatttatgatggaggcccaatattcaccgccgggttttcccgcaagcgccaacgcgagcagctttccggcggccaaaagcgcgccgggacggattggcagatgcttgccaagcaccttgctgacaaataggaacgctcgctgcgggttctgccgcgcagccagcccgaacagcgcgtcaggggaaagattaaagcgcggcgtatccaattccagcgtgagccggaggttgttttcaagtgtaaaagatgtaatcatgctttaaattctccgccatataccgcgcgcaggaagccggcagcattggtgttctcctgataaaccccatagacatgcgcgcgctgcagcagcttgcgcgcccagagtgtatggggtttgagttcattcatcttattctgccggacgcttgccaacacgccgacagtgccctgatcgccgctaagaatgcccaaggcgtcctgatattgctcatagggcacagtataacttgcctgcacaagcggaagctgcgttggatggacgcacgttttaccgaggataccgttttgcaggtcgagccgtacctcgcgcagaaggctgtcgatctcatcgctgcggcgcagggcgcaggcgcgcgcaaaggtgctgaaatattcccagactggcccgctgacggtataccggtcgtcaatagcgaaaatgcgcacgatatccgcgatgataccggccgccacagcgatgctgtaaatgggggtgtctacgctgcggcgaatgccgtaaagcccgcagagatctgtcgcgccaacacggatattgaggatctgatcgctttcatccgcgatttcgcgaagctcgcgcagaaatatggtacggtcgtcgcgttccatcaactctcgcgactccagaatcggcatgacataaaagggttcgcatgcgcgccgcccgatgtccgcagccaacaccaacgcgcggcccaaagcatccggcgccgctttgggcaggataacgcctgtgataacacggctgtaagaaataaagaactcagccaaatcctcaagcatggcgcaatcctttacgcggacaaacaacaatgggagcctgttttcaggcaggctcccattgtcgagcgcggcggccaactgctcaaactgcctctgcgtattttccacacatctgatgcggtcgtcatccccgacggaatcctccaggcaaaccgccattgaggtaagctccgggattttcccattgatgatggaacgggcgatctggcggttgaaggcgggggtatataaaagcccgccaaccgccaaccgcagcgtttcacgttctgtagttttgaaaaacgcttccggcggtttgaaaaacagactgcttaaatcacagtcggacagatagtcgaaatactgcataaatttgtatcagcctttttgtataatttgtcggctacccgggtgttgaatcatcagacattcaagccgtactgcctgcaaagcgcctcgagtccgccgttgaagccggaaccgactgcggagaacttccattcgccgttgtgacgatagatttccgcaaatacgatcgccgtttcggtcgaataatcctcgcccagatcgaagcggagcagctcggaaccggtctgcttgtccaccagacggacgaacgcgttctgcacctggccgaagttttgtccgcgcgcagacgcatcgtagattgtgaccgtgacggcgattttctggatgtaatcggggaccttttcgaattcaatcgtaacggcctcgtcgtcgccatccccttcgccggtgcggttgtcgccggaatgcgtcaccccattggacgacaggttgttgtagaaaataaaatcggattcatgcgcgcatttgccgtttgcattgagcaggaagatggaagcgtccagatcataatccgcgccgctgtcatactgcttgatatcccatccaagccccaccagcgcgaccttcaggttgggcgcttccttgctcagactgattttttgtcctttggaaagattgattgccatgtaaaaactcctcccatatccgtttatctgtatttcgcgacgatttcactcaggcccggatcatagccgggctggccgacggcattgaatttccatgctccgtccttgtggtaaatttcgcccacgatcatcgaagtttttccggagtaatcctcggtcagattatagctggcgattgtctcctgagaaccctggtcgacgatacggatatacgcattttcgaccatgccgaagtgctgcttgcgtttgacgcagtcgtagatgttgacaacaaaaacaatccgttcgatgccctgcggtaccttggtcagatcgacctggatctgttcggaatcatccatgccgcccattttgccgccgacaaggttatcgccgcagtggtggatgcagccggttgcatgatccttgtggttaaagaaaatgacttcctcggggcttggaattttgccgcccgcatcgagcatcaggacggacgcgtcgatatcaacatcgaccttctgcttaaacatgccaaacaagccgctgctcgcctgaacttccttccagccaagaccaataaggatattggtaagctgcgagccgtccgctttgctcaggttgattttttgaccttttgtcagtgatatcgccatattgatggcctcgctttccattataaattgcgcggctgtgcggccgcggcggttgggatcagacgctcaggccaaagttgcggcaaagagcctcaagcccgccctggaaaccggaaccgatggccgcaaatttccattcgccgccatgacgatacagctcggctacgacaatggccgtctcgatcgaatagtcttcgccgaggtcgtagcggagaagctcctcatttttagccgtatcgacgatgcggatatatgcgtttgacacctgcccgaagttctgtccgcgcgcctgtgcttcatggatcgtgacggtgaaggaaatcttagcgacatcggccggaaccttgctgagcgtgatattgaccgtctcatcatcgccctcgccttcgccggtccggttgtcgccggaatagacgacgctgcctgcggcgtccttgggattgttatagaatacaaagttggtgtcggtatccacctttccctgctcgtttgtcataaaaatggaaacgtcaagatcaaaatcatgaccgccatcgtaacggttggtatcccacccaagaccggcgaggatgctgtcaagaccgggattccctttggtcaggtctactttttgtcctttggaaagattgatcggcattcaaatacactcctttattataatggacattttggatctgttaacaaagccgccgcacccaaaacagcggcgcttaattccggcatctttcacaaaaatactcgttaaggcacaaaggctctcctgcggttttttgttttatcttccgaaaaaattgctcttgttttgacactgcttggtttgtcaacagctctattttgccacagggttcaatcactggtgcagacgattctgaaagtcctgcttgagagcttccagcttgactgcgtcctcgcggcgcttggcgccggcttcatcctgaatgcggcgcgtttgctcaattccctcgacaatcgtgtgccaggtctgttcaagcgtttccaccttgatggagcttgacgaagcgagctgtgcggtcagcttggcctgttctgccgtgttgcgcgcatttttgagaagcatctcattcgtgcgctcgtcgagcgcctgcattgcttccgcctgaatcttctgccgcttgagcaggaccgcctgcgtcaacgcctgcttaaagaccggcagcgtgatgataaacgccgagttgattttgcggatcaggttaagattgctgaactgcatcgactgaatcatcgggatcgactgcatcgctacattttctgcgatgcgcaggtcctggatacgctgctcaaggatggtgcgcgcctgctgcatggcgcttaaatcgagctggagcatatggtcgtccgggcgcgcggcgatatccgcctgcatctgcgacaggtactgatccatttccgcaagaccctgctcgccggcgaggatgtatttcaccaggtcctggtaaaaacccacgttggctgtaaagatggcctgaagcttttgattcgattcaccgatttccgcctcgtactttttcagctcaatatagatcttgtcgacttcctcgcccatggtgtgatacttggccaaaatctggtcgagctgtttttgcatccctccgaaaagctttgcgagcacgccttttttttcgtcggaggcaatctcctcaatatcgaatttatccatgattttgccaagcgtcgtgagcagcgttcctgattcgttgatctggttcatattgatgctgtttaagattgtgtcggagcattttgcgatttccgccgcgacctcgccgccaaaggtgacgattgtttgcgggtcatgcacggcgatctgactgacaagccggtcgatctcctgcgaacccttgagcgtgagggccagctcctctcgctttgcggcggcgtcatagacctgcggggcgccgctgtcctgcggggcgccctgctggggggtaaactgtagggccatgggatactcctcctttttggatgcggtgcgaaccgccgtttttatgatgatctgcccgggccgaacaaacggcccagaatcgagtcggacctttgcagtcttggaaccgtgaggttaaattcatactcgccggcaatcagcgtatcaaaacaatccgcgcgaatatgctgttcgatatttttgtagccggttggggtgaagatcgcgatatcgaagccgacaaggtttaaaaacgctaaaacgatgcagttgttcagcgaaaacattttttcgtcgacatcaaccgaaacgacctttgggatctcgcgtgtgaaatcaaaattctggatcagccgcaccagctccacatcgatcccggaaagaacagatatgatgacggccggcaaatcggccgattcatcacaaagcatattgtagtcgatcaggtcctggatcttttccaggatataatcctgtaaatcgtccggcagatggctgtatgcataggccggttcctttttgacagcgaccggatcgagcttatccccgtgcaggcatctcttttgaatattgtctgccggtatcccggatgatttgtcggcggcgatatccgtcagcaggtaggtgtcctcgccaaccaagctgcggatctgcttccaataggcgttgacgtcgcccttttccacaccgcagatctttacaaataggtttggaacgtttacaacgccgtccttcgcctcgaaagacgggcgaaactgtgcgttttcatgccagagctgccacacttcgtcgtaggtggtgcgcagcgtaacggcgcgcgagcgggtaaactgccggtcgcggaacatgccggtgtcgttgtaaagaagctgatccagctcacgggaggcgttatatgccgctgttgaggcgcgcacacgttcctcacgcgttggaaacggctcaaccggcaggctgctttttagcagcgtctctgtccagatgatgggcaaaaacgcgccggtaaatacatcccgggcggacggatcggggaagaagcagagcacatcgattccagcctgcgccaacacccataaaaggggaagctccgtttccgtgatgctgccataacagacgacaacgggcgtctcatccggggttttgccggcaaagagcctgtccaaacagcgtgtgatccagcaggccagccgcacgccgtaattaaaaaggcgaacaagatcctgaatgggaacgcgctccaacgcctgcgcaaaagcgcgctgcacagacagccgccttacctgcccgcaggagggcgcgagccgttcagccagcctgcggatcaaatcgctgcgcgcaccgcgcttatcgacgccgcgaaagggcgccgtttcctcgacagacggcgcggacaaattctgatcaagcagcagccattgcttgacggagccttcaagcgcggttttcagatgaaacaaccggttgcggtattcggcgcgctcatcggcgccaaaccagactgcaaacaggctgtgcagcacgccgccgcgctgcgcggcgggacgcatgacagcttgtatcgggggcgcgccgccagcccatgaattgatacacggctgatcggacatgcgctcccatgggcacggtccgttttcaggcggcttcggcccttgctgcgcggcaggctcaggctggccggcgccggctgtaaagtgaagcgggggcatggacaaaagcgcgccgcgcaccaactctgaatatgcgccggcggggtcggccttttgatatgacgcgtctgaacaaaaatcgacataaacaacgtcgcagccggcaagatacagcgcgtacagcagcagcgcctcatatttggagatgtcgccctcaaacagaattttaggcggggaggacttgccaatcccgatgagcacgggaccaaagcgggaacgcagccagcacatgaacttgatgtaggcgtttctgacaatgttgtcattgctgccctgttttttgagcagggccagcgcctcggccagcgcctctgccagaaggtcgcgctgcgcggggcggacctgaccaagccacatggtaatatggcgtgaaataaattccctggtgaatgcaaaccgctctccaacggtgctgtaaaagcgggtgatctcgctttcaacgggattgtcgatcccgtcgggtatataaagcccttcgctgcgggtcagttgataaaaggcatgcagatccgcgagcacggcgcccccagcgtcgcgcccgatcacgcgatagaaacgggccgactgagggacgcgctgctcaacgggcaaaaaacactggcccaaagggtggctgctgctcataaattacgtactcccattcaccgtctttttctgcaaacagcggcgaatgctgtgtcaaaaagcctcggaatccaaaaggattcctgagcttttgcgctgccttctcctgccgcttgcgaaaattctggcaattcatctattttcaaacaagccccggcgaattatcggacggcttgttatttacgtccggcgacccatcggaatccgaagcggtagaagtcgtccacttctttgtgcccctggaaaaaacgttcttcgcgttttacctccagctctccgctttttcccgacaggcttgcaaaaacacagaaacgatttcggctgtccgggctgtcgatctgtatttcaatatcaggcgcgccggactgcttgatcgtaacagacgcgtttgtgccgcgccaattgggcgtaccctcataaataaacgcaaacacaacggcaaaatcgatcagctccggccgtttgaaaaacatattttccccgttggcgcttgtcccggagcgatcgtcctgatcgagcaggatataggggagctgcgcggcgctgccgaacgaattgccaagcgcctggatcacgccttgttcgcctgatttcagacggaacatgcaggcaaggtcgaggtcgaccgcaccgccgcctccaaacagttttttacgtcccgtgttccagttcagattgacatgaagctcgccgctgtttttggacagattgatcctgtggctgtcgccgctttttttcaggctgatcttgctcaggttcactttgggagcggaggcagacgcgggggagggaaccggcgcgggagctggggacggcgcggcctgttgctgcggattggccacctgcccgccgaaatgtgtcaaaagcgcgtccaggccgccattgaagccgctggaaacaactgtatagcgccaaataccatccttgcggtacagctcgcagaggatcaaagcgcgctcctggctgaaattctgcccggaaaagcggtaatcagccgagctgccgccgctgcgcagcgaaataagcccctcggaaacgtcgcggatcaggccgccgtccgttgaaaccgcgatgaccagcttttgaatctgctccggcaggcgatccgtttgcacagtaaaggcggtctgcgcgccggatgtcatgacaatggcgttgtccggagaactgttttgattatagaaaatgaagtatcggtcgtctgaaattttgccggcggcatccacaccaaagcaggtgaaatccgcctcgcccgcgccggtttgcgcggacacaacgatttcgatctgtgtggaggatgtaaaatcggacagctttagcttttgtcccttttgcagttccatacgttccttttctcctttcggggcgtcgatcaaaccatctgcgtttggcctgcaatattcatttgcagagaggccctcttttaccctaaaagcctgtttgcaatcgtccgtgaaggcatttttttgaatagatctatgcccctgtgatgctcaacagtttctaagatggccatcatacttatcaactataatacatccatatttcgacaaatgcaatgcaaatttgtgaacaattggtgtaaaattgcgatcattttatgaaaataaaacaaagcgataaaaacccggcggttgttcccgccgggttcctaataaggacgcttatccgatctggaaaatagccatcgacgcattgcacgcctgcagcggagatgccggaagcaggaccgtttccggcgaatatacgcccaaaaaaatttgctctccttctttaaaaggatatagaaagttcccgctcgcacaggcatgattgatcagcatcggctttacagaacctgtgatggccgaaggcacagcgccgttttgaaggagaacgccaacaccggcgttggtattggctccattgattggcgtgatggaatagatgactgcataaaatcccgtccgcagaagtgtgaccgtatgtccgtcgctttccaatctcatataatagggggtatccgcctgaagctgtatcgggacaaaatatccggcgggttccaagctttgggccatgtaggaataaaaattgccggatgcggggaaaggaagcgtcccgcaggcgccggtgggacctgtagcaccggttgggccagtggcgccggtcggaccagtggcgccgggaattcctgttgggccggtcgcgcctgcctggccgattggtccctgaggtccctgcggcccaaccaccccttgcggtccagccggaccggttgcgccggtcgcgcctgcggcgcccgccgggccttgaataccagcctgccccatggggcctgtcggtcccgccggccccgctggtccttggattccggcaggaccagttggtcccgccggtcccggaatcgggacgacgcagcagcagcctggcggacagcagggcggcctgggcacaaagcgttggtcgttcatggatataacctcccgtttcaagagaatgtgaaccgaaaacgtgcgctttcggctttggtgaatttcgctttgaccggcggccgatttggctgtgggataggcggcggccgggaagatgcggttccctatcaatcattttatggctgaatgtgaaaatgcgttcttttttgcggtgaagcattacaattttccacatgaaacggggccaataaacagtatgcgcgccggaagcttccggcgcgcatcttgggactgtttcaacatcttgtcggaaagagatcgtacatccaagcttttaacagagcgatttttacaaatccttgacatagctgcggatcacatcggtggaagcgtggaattttgcctgttcctgctctgtcaaagggacttggacaatctccttgacgccgctgcgtccgatgatggccggcacgccgcaaaaaacgccgtgttctccgtattcgccctcgagcagcgtggaaacgggaatgatgcggttttcatcgtgcaggatgcatttgatgatgccggtggcggtcgtggcgatgccatagtaggtggtgcccttacgccgcaggatctcccagccggccttgaccgtgtcgtgcacgagcttgtcaaggtctaccccctcaaagcggccgggattatcgcgcagaacttccgcgaaggttttgccgcccacggtgacgcgcgaccaggggacggtctggctgtcgccgtgctcgccaagcgcataggcgtggacgctgcgcgggtcaatgccgaccagctcgccgatcagcgccttgagacgggcggaatcgagcgccgtgccggtcccaaggacctgattttttggcaggccggacagcttccaaacatattgcgcgatgatgtcgaccgggttggagatgatcaggaataccccggaaaaaccggcgtccatgatcgggccaacgagcgaatcaatgatttttttggagagatcgagcgaatcgaggcgcgtctgcccctccttcggtggcggaccagcggtgatcacaacaatatcggcgtcgccgcagtccttgtaatcgccgacggaaacctttacgttgcgtcccagatagtcgataccatcacgcaggtccatcatctcgccgtgtgcgcgctcctgattgatgtcgaccagcagaatttcgtcgcagacgccctgtgtcagcaggctgaacgcggtggacgatccgactaatccagccccaatgacagcgaccttgcttgcattcattctcatataaggctgcctcccttagctgttgtatacaggcttgccgtctgggagcctgtccggctttttcctcaaattaagccttagtagtatttccgcaccgtaccatcgaaatccgggcggcacggattttttacaaaaaggcgggcggcaaacctgccgcccgcctttgggtatgtttgaattatagcaattttgcacgaagattgcaagtgatttttagataaaattttaattatcttccgccatcaggttacatacggaattcgaaaaggcaaccggatcgtcaattgacattccttcgatcagaagcgcctgagcatataaaagcgatgcgtattccttcaggcggtcacgcttgttttcatcggcatacagcttttgaattgcggcaaacaccgggtgcgacgcgttgatttccagcacgcgctccgccttgaccttgttgtcgttcggcatggcgttgagcacgcgctccatttcgagcgagagcatcccatcgctggccagacagaccggatgtgattttaagcgtccggacaggcgcacttccttgaccttgccgccgagcgattcgcataaaaaggccagcagctccttgttttcttcattttgcttttttgtttcctcctgttcggccgtgtcctccaacccaagatccttgtccgatacggacttgaactgtttttcctggaaactgtaaagcatcttgagcgcaaattcgtccacgtcgtccgtcagatacagaatttcatatccctggtcgcgcagaagctctgtttgcggcagcaggccgatcttgtcgacggtttcgccgcaggcataataaatatatttctgcgattccttcatacggccgacatactcctcgagcgtgaccatcttctgttcgctcgacgaataaaacagcagtaaatcctggagcagatcctttttcgcaccgaaagcgtcgtaaacgccgtatttaagctggaggccaaagtttttaaagaaggcttcgtactgctcgcgcttattgcgcagcatcgaaagcagctccgaatgaatttttttctccagacgtccggcgatcagcttgagctggcggtcgtgctggagcatctcgcgcgagatattgagggagaggtcctgagaatcgaccagcccgcgcacaaagctgaagcagtccggcagaaggtcggcgcatttatccatgatgagcacgccgcttgcatagagctgaagtcctttttcatagtcgcggctgtaatagttaaagggcgcgcgcgccgggataaacagcagcgcgttataggtcgcggatccttcggtattgctgtggataacaagcgcggggtcctcgaaatcgccgaatttttccttgtaaaaattgttgtaatcctcatccgtcagctcggaacggtttttgcgccagatcggtaccatgctgttgagcgtttcgttttcagtatagtcctcgtattccggcttgtcctccgggcagccttccttcaggcggcgtttgggcatgtccatgcggatcggatagcggatatagtcggagtagcggcgcacaagcgcggcgatgcggtgcgcgtcgagaaattcgtcgtaattgtcctctccctcgttgtccttgatgcgcaggacaatttttgttccgcgctcggacatgtcgcacggctcgatcgtatagccctcgataccgcggctttcccacttccaggcttcgccggcgccgtgctgacggctgtaaacggtgacgcaggagctgaccatgaacgctgaatagaacccgacgccaaactgcccgataatatcgatgtcatccttatgctcgccggtttcctcctgcttgaaggcgagcgacccgctttttgcaatcgtgccgagattgctttcaagctcgtcgcggctcatgccgattccgttgtcaataactgtaagcgtgcggttttcccgatcgatggatagactgatcgcaaaatcgtcacgcgacaggcccgtgatattttcgttgagagagtgatagtaaagcttatcgatcgcgtcggaagcgtttgagatcaattcgcgcaggaaaatttcccggtgcgtataaatggagtggatcatcatttccagcaggcgcttcgattccgccttgaattgctttgttttcatggcatcagaactccttttatatgaatgttttaaatccagcggaattagcactctttttatatgagtgctaaccatactataatatacctgtcctgaaaaatcaagtataaattgtgaacaatttggagtcagcccgtgcgcaggcgcggttgaatcgctcttatgcatgtggtatactgttattgtgagttatcaaaaatccgagggcttggtgagggacatgcactacaaggttgttttgtgggattttgatgggacgcttgtcgatacgtcggaggggattttccgttcactggaatatgcgttcaggcagcttggaacgccggcgccgggccgtgatgtactgcgcaggttcatcgggcctccgctgctttattcatttcagacctacattggcatgtcctatgaggaagccaagcgcgccgtgcttgtgttccgggacgattacgaggcgggcggcatgtatcgttcgcgcgtctacgacggtctgcccgagttgattgcgcgtctgcgccaaaacggcgttaagacagccgttgcgacgctcaagccggaggcgacagccaaacagcttttgcatcatttcggcatggagggcctctttgacgcctgcaccggaaatacgcctgatgaaaacgatcagacaaccaaggccgacatcatcagaaggacaatgtgccgccttgaatggacggaccgttcatcgatggcgctgattggcgattccgtctatgacgcgcagggcgcgcaggaggtcggaatcgattttatcgcggcggcctatggttttgggatcggcgcccgggaacgcgccgcgcttgactgccgttttgtagccgaaacgccgcgcgatttggacacattttttttgcaggataaatgtgttgtatgaaaaggaggggaatcggttggatcgaaatttgatggcggtggttgaaaaacgcatcgaccgcacgatcgggaacctgaaaaacaacaagatggacgcgtattacgtaaaaacatgcgccgatgctgtggcgctgatccgtcagctctgtcctgcgggtcagaccgtctcgtgcggcggttcggtcacgctggaggagtgcggcgtcaagaagttattgcgctccggggaatatacgttccttgaccgcgaggcgaagggcgccgacccggaggacatataccgccggacgtttggctgcgacacgtttttttgcagcagcaacgcgattacggaggcgggtgagctttacaacgtcgatgggcgcggcaaccgtgtcgcggcgatgatctatgggccgaaaagcgtgatcgttgtggccggctacaacaagattgtgcccgacctggaggcggcgcgcgcccgtctgcgcgatacggcggcgcccgcaaacgccatccgcctgagcacgcgcacgccctgcgccgtactcggcgcgtgccgggactgccacagcgacgaccgcatctgctgcaattatgtcgtgatggggcagcagctcgttaaagggcgcgtcaaggtggttattgtgggcgagacgctcggattttaaggatatttaaaaacggtccccggagacgcagtctccggggaccgttttgcaagtgtcagatattgacggagcgcgcgcggtcgaacagctcctgaacctccttggacggctgcttatcagccagcgaaacgatgacgatcaccgccagagcgatcacaaagccgggagcgagcgaataaaggccagtggccgcgagcgcgggaatattttcccacagcacgacggtcaggccgccgacaaccatgccggcaacgcaccccttcatggtcaggcgcttccagaacagcgagagcaggatgaccggtccgaaggacgagccgaagccggcccaggcataggagacaaggcccatgacgctgctgttcgggtcgagggcaagcagataggcgacgaccgcgataatcataacggctgcgcgcgacacccacatcagctccttattggaggcgttgcggcggaaaagcgccttgtaaaaatcgttggaaacggcggacgcagcgacaagcagctgcgaatctgccgtgctcatggcggccgcgaggatggccgaaagcagcacgccagcgataaagcccgggaacaggcgcgtgacaaggtccatgaaaatgacctctgccgcaccggcatccgtgtaatagccgtgattgccgaggaaagccagcccgatcacgccgacgcagacggcggcgacaagcgtgattacaacccagatcatggcgatgatgcggctctttttaatcatggcgctgtccttgatggccataaagcgcacaagaatatgcggcatgccgaaatatccaagcccccagacaagcccggaaataatggttacaagcgcgacttttccgctggcgtcagcgaacaggttgagaaaattgtcgccgcccaggctcacgatgaaatcagacgaaagaccgggcgtattgaacgcggctgcaatcggcacaatcacaagcgccgcgaacatcagcatgccctggatgaagtcggtccagcatgcggcgaggaagccgccgagaaaggtgtatgcgatgatgacgatcgagccgattgtcagcgccgtgacgtagtcgaagtggaatacatattggaacagcttggcgcccgtgctgaacgcggaagctgtgtagaccaggaagaatacgaaaatgatgacggcgcagacgctgcggatcgcagtcgatttgctcatgaaacggttttgaaggtactgcgggatggtgatcgaatcgtcggcgacatacgtgaatttgcgcagccgcactgcgacaagcttccaattaagatatgtaccgatccccaggccgatagcaatccacgcggcggaaagcccggaccagaacgccgccgcaggcagcccgagcagaagccagccggacatgtcggacgcctgcgcgctgagcgccgtcacccagctgccgagctgccgtccgccgagaaagtagtcggaaatgtttttcgatttcctgtagaagtagatgccgatggcgagcatcgcgccgaaatagaggataaatgcgatcaggatgcttgtgtcaatctgcatgtaaaatccctcctcaaattttgccgcaaccttttacctctttgcttgctttttgtacagatagacattattatacataatgcgggctttctttgcaagtgcggattgccgcgctgcatgtttcaaacgggacgatcatgatgatggaggagatgaatcacgtcatgaagcggatgctggcccagtgcgccggatcgaccggcgcgctgttgatttcatatctgcttagcagatatctgttttttgacctgcacggcatgaaatcgtttccgttttacctgctgtgcgccggcgtcgccgtatcggctgtcgcggcgttttttcacgcgggaatcttgtccgctgcggcggcagtgggatacattgccgggtttttctgcggtatggcgttcggcagcgtgggaaccgatccgggcggcggccgcacctgcagcggatggctgatttggggaggcatttttttcggttgcctgctgatcggggcggttttgcagcttgtgcggcgaggcggccgaaagccggacggttaagctgaacaggcgcgtttggagcaaagggagaacggcccggctcaagcgcggacggccgatgaaaaatatccgcagagaacaattattattgacagaaggcttggagctgttataataggaatatattgtcgaagcatggcggagcggtggagaaccgcttgacgctgtgggcattgatataacacaggaggaacttaggtgatgtttggtaaacgcggcaaacatttgatttcagttatgatgacgctgctttgcgcggcttttcttggcatgcctgtatttgccggcattccttccacgggcgatggcagcggtatgcttctgccgattatgggcggattgttggtcgtatccattattctgattgttgtatatgttattctttccaagaagaaaaaacggtagcagtttggggcagctggcctccccggattgcggggaggcgtttttatttattcaccgctttatctgaacaatgtgcgaaagcgcaagaaatcgctggaatcgcgcccattctattgtacgaggccgggcgcggtgatataattatatgtaattgcggccgccgcgccgtgcaatatgaaaaaaggcaggggggaatggcttgcttgagcagctaaaccggattgtggttgtaacaggtcattacggcagcggaaaaacgaatctgtcggtgaatctggcgatgagcctgcgcgccgccggcgaggaagtcacgcttgtcgatcttgatattgtaaacccatatttccgcagcgccgacttcgagacgctggcggaggaaaacggcatccgcctgatcgcgcctgtatatgcgcgttccaatcttgatatcccggcgctcgacgggcggctcgacgcggagcttgacggcggccggcgcatcgtgatcgacgtcggcggcgacgacgcgggcgcggccgcgcttggacgctacagcgcgcacatcaaggagagcggcggatgcgatatgctgtatgttgtcaacgcttaccgctatctgacgcgtacaagcggcgaagccgcccagattctcggtgagattgagtgcgcggcgcgtctgacggcgacggccgtcgtcaacaattcaaaccttgcggagatcacaacggcagaggacatctcgcgttcggcggcatatgcccgggaaactgcgctgcaatatcagataccgcttttatttacggcggcgcgcgaggatctggcggacgccgtgcgcgcgtatgcgcccggcctgccggtttatccggtgcggatttatgtcaaaaagccgtgggaggcttaaagccgctcgcgttccataaagcatgttttaatgaaggaggtgttgaggtatggcgaaaatgacggtcaatcgggacacgtgcaagggctgcgggctttgcgtgcaggtctgccctaagaaaattatttctcttgacaaaaaggcgctgaaccagaaggggtatcatcctgcctgcgtcgaggacatgagcaagtgcatcgggtgtgcgatgtgcgctcagatgtgtccggactgcgcgattacggttgagaaatagaacgggcgccgcctggcgcagcgcgccggggcggacagtatgcaaggaaaggcagtgaaaacatggctctgaccgaaaaggttttgatgaagggaaacgaggcgctcgccgaagcggcgatccgggcgggctgccgtcattttttcggatacccgatcacgccgcagacggaagtcgcggcgtatatggccaagcagatgccaaagatcggcggtacatatttgcaggctgaatcagaggtcgcagcgatcaacatggtctatggcgctgcgtcggcgggcgtgcgcgcaatgacctcgtcatcctcgccgggtatttcgctcaaatctgaagggatttcctacatggcgggcgcggacctgccgtgtttgattattaatgtgcagcgcggcagcccggggcttggcggcatccagccgtcccaggccgattactggcaggcgacgcgcgcgcccggtcacggcgatctgcatgtgcttgtgttcgcgccgtcgtccatccaggagatggtcgacatggtatttgacgcgttcgatctggccgattgttaccgtgtgcccgcgatgattctcgcggatggcatgctcggccagatgatggagccggtcgtattcccggagcgcacggtcaagcagtatgacaagggttcctgggcgaccaacggccatcagaatcagcgcgcgcataacattgtcaactccctgtacctccagccggacgagctggagagccgtatccttgagcggtttgaacggtatgagcaaatcaagcagaagcacacgcgcagcgaggaatatctggttgacgacgcggattatatcgtcgtcgcatacggcgcgacctcgcgcatcgtgcgcagcgctgtcaatacggcgcgcgccagggggatcaaggtcggtatgatccgtccgatgacgctttggccgttcccggcggagccgattgcgaaggcggccggacatgcaaaggctttcctcagcgtggagatgagcatgggacagatggttgacgacgtgcgcttggcggtcaacggcaaggcgccggtcggtttcttcggacgcaccggcggtattattccgacgccggcggaggtcctttcggaaattgaaaaaatggcgggaggtgacaagtaatggcagttgtttatcaaagaccgcacgcccttctggacgtgcccacgcattattgccccggctgcacgcacggcgtgatccataagcttgtcgcacaggcgatcgacgagcttggctgcgaggggcgcaccatcggtatcgcgcctgtcggctgttcggttatggcgtacaattattttggctgcgatatgatcgaggctgcgcacgggcgcgcgcctgcgattgcgacaggggtcaagcggtccctgccggacagcgtcgtattcacttaccagggcgacggagatctggcggccatcggcaccgccgaaacggttcactccgcgacgcgcggtgaaaatattacggtcatctttgtcaacaacgccatctatggcatgaccggcggtcagatggccccgaccaccctgccgggccaggtgacgcagacaacgccggccgggcgcgacgttgcttacgcgggtttcccggtgcgcgtgtgcgaaatgctctcaacgctttccggcgttgcgtatgccgagcgtgtggcggtcgacagcgtgccgaatatccgcaaggctgccgccgcaatcaaaaaagcgtttacctgtcagattgaaaagaagggcttttcaatcgtcgagatcctgtccacctgcccgaccaactggggacttacgcccgttgaggcgctccagtggctgcgcgacaatatgatgccgtattatccgctcggcgtctatgccgacaaaacggaaaagggggtcaggggctgatgctgagtgtgcttttagccggcttcggcggccagggcgtcctgttcgccggaaagatcatggcgtacgccggtttgattgaggaaaaatatgtttcctggctgccatcctatggccctgaaatgcgcggcggtacggccaactgttccgtatgcctgtccgacgagccgatcggttccccgcttgtgctgaatcccgatgtgctcatagcgatgaacctgccgtcttacgacaggtttatcgaccaggtcgctccgggcggcatcgcggtcattgacagctcgctgattgcaaaaaggagcgatcggaccgatatccgctgcttttatgtcccggcggctgaaaaggcggacacggagggcctttccggcctttcgaacaatattctgctcggaaaggccctccaggaagcgcgctttgcttcccttgaggcggtggagcaggctgtagccaaatgcgtgccgcctaaaaagcagcaccttttggagccaaatatccgcgcgatcaaattgggcatgagcctttaatgcggttgcgtaccatgaagcgcggcgcctccctgcgtcaaagacacgggggcgccgcgttttggcgtgtcaagagctcgacgcgctgctggcgggcagccatttctctacacgccaagagccgccgcgtctgccgcgcttgtatattcggcaacgatcggatataatcaagaacgtatagccaaacagcccttggaaggaggaagcggcgatgctgcatttgatttttggaacggccggcgccggcaagacgacgctgctgcatgaacgcatcgccgattgcgtatcgggcggcggcagggcgatcctgctggtgccggagcagtattcatttgagagcgaaaaggcgctttaccggcggttgggcgcacgcggcgctttacaggtggaggtgctcagttttacgcgcctttgcgaccggattttccgggaatacggcgggcttgcgggcgtgcatctggaggacgccgcgaaatatcttttgatgagcgtggcgcttggcgaggtgggcggcgcgctcaaggtctatggaaaaaatgcagcgaacgccgcgttcgctgcctcgatgtgcgaacagatcagcgaattgaaagcggccggcgcgtcttctgaggctctgcgcggcgcggcgcaggatttgggcggcgcgtttggggacaagctttcagacatcgcgcttatttttgacgcgtatcaggcggtgatcgaacgcggctacagcgatccggacgactgtcttgcgcgcgcctgcaagcgcctggaggggcggaatttttttgccggctacgatgtgtttattgacggctttatggcctttatgggcgcggaatggaatcttttgaagtttgtgctggcggacagcccgcatgtctgggccgcgctgacctgtacgggcctttggcaaggcgatgggaccggcgcgctcgcatgcgcggcgcatacggcggcgcgccttgtgcgcgccgcgcgggaggcgggcgcggctgtggccgcgcccgccttgctggaaacgccgcgccgattcgcgtccggcgcgctcgcatggattgcgcaggcgtatccgcaggaggcgcctgcgccatacgacggcgcgccggacggcgtgcagattgtggcgtgcgaggacgtatacgacgaaatcgaatatattgctggggaaatctgcgcgcttgtccgagagaagggataccgctaccgcgacattgcgctgatcggacgcgctttggaaccgtaccttgtcccgctggagacggtatttgcccggtatgatattccatattttgccgaccgccgcgttgatatccaggtccatccgctcgtaaatggaatcttctgcgcgcttgacgcggtacgcggccgttttgacagcgaggcggtgctcgcgcttgcaaagacatgtatttccggaattgacgccgtggaggcagggctgctggaaaattactgctttacctggggcgtatccggcacggcgtgggccgcgccgtttgtaaatcatcccgacggaatggagggggcgttttccgacgagcagcgcgaacgactttcacggatcaacgccgcgcgcgcggcgttgatcgggccgctggagcggctggcggacagcctgcgcggctgcgacgggcgcggctttgcgcgcgcaatctattcctatttggagcaggttgacgccgcgtgccgtttgcgggactatgccgaagggatggaggagggggatgcgcggcgttttcttgatttaagcgcgcaggtttgggacgcggtgatcggcctgctcgatgtgttcggcggcgcgctcgcaggcatttctctgccgcttgcccgtctgacagacctgctgcggttgggcgtgtccacggttgatatcggttcgctgccccagacaatcgaccaggtgatcgccggtacggccgaccgtatccgcccgaacgcgccgcgcgcagtctttgttatcgggctgaacgagggcgtgttcccgttgtggagcagtccgtccggcattttttcagccgccgagcgcgagcgcctgcgcacgcagggggttgatctgctgcgcacgccggagcagacggcgctttttgaacggtattatgtttactttgccctgacgcaggcgtccgaggcgctttggctgacctatccgctgcgcgatgcggcgggggccgcgcgcacggcctcgtccgctgtggacgaggtacgcgcccttgtgggcgcgccggcgcgcggctctgccggcggcgcgttggcgcgcgccgccggcgaacgttccgcctttgacgcaatgatgcgccattggcgcgacgatacgccggaaacagcggtgctgcgaagttattttacggagcaggacccggcgcgcatccgcatgctggaggcgctgggcgcgccgcgcgccttcagcctggaaggccgcggcgcggcgcgcgcgctgttcgggacgcgaatgcgcatctcgccgtcgcgtgctgaattgtattatgaatgcccgttttcctatttctgccgggtcggcctgcgtctgcgcccgcgccgccgcgcggaattcaatccaattgaatccggttcgctgattcatctggtgcttgaaaagattgtgaagaaatatggcggccgcggccttgcgcagctcaacggcgagctgctgcgcagtgagatcaccgcgatcatcgacgcggatttaaaggcgcgcatcgccaattacgacgagatgcccgcgcgctttaaatacctgttccgccgcctggtcggtacgattcagcgtttgatcgagcggctggcgcttgagtttggccaaagcgcgtttgaacctgcggcgtttgagcttcccattggacttgacgcgccggtgcagccgctcgacctgcgcgcgccggatgggacgcgtgtaatcgtcgaagggattgtcgaccgcgtcgacgtgctcgaacaggacgggaaaaaatatgtgcgtgtcgtcgattataaatcgggcgcgaaaacgttcagcctttccgacatctgttatggattgaatatgcagatgctgatctatctcttttccatctgcgaggcggacggcgccgtgccggccggcgtgctctacatgcccgcgcgcgacagcgttatacaggcagaaaggaacgcgtccggcgaggaaattcaggcgcagcggcttaaacggctgcggatgaacggcattctgctggaggaccgctctgtgctctcggccatggagccgaatctcgctggcgtgtttattccggtcaaaacaaagaaggacggcagttttgacgcacgcagctctctggcgtcgctggaacagatggggctgatccggcgtgaggtggaacgtcgtttgatcgggatcgcacaggggctggccgacggaaaaatcggcgcggagccggtcgaagggctttccaattacaggccgtgcgactggtgcgactatcacgctgtttgcggtcatgaggacggcgatgcggtgcgccgtctcgcggagcttgaccgcgctgaagcgatgaaacggatggaggaggggatgggcgatggctgaacgtcaatggacgccgcagcaggcggatgcaatcgccgcgcgcggcgggaccgtgcttgtgtcggccgcggcgggaagcggcaaaacggctgtgctggtcgaacgcgttgtcggacgtatccttgacgaaaaaaatccggtcgacgcggaccgtctgctaatcgtcacgttttcaaacgcggcggcgcttgagatgaaacagcgtatcatggcgcgcatgtccgagctgattgcggcgcatccagaggaccgccgcctgcgcaggcagcagcttctgcttgggcgcgcgcagatcagcacgattcattcgttctgcctggagctgatccgcagcaatttccaggcgctcggcatcgcgtcgaacacgcgcgcagctgacgagcgcgaattggaaatcatgcggcgcgactgcgcgcgcgcgtgcatcgagcaatttctgtccgacgacgcggacggcgggttttcacagcttgtcgagctgttaagcgcgggccgtgacgaccgccgggtgtttgatacgctgttttcgctctatgattttgtacgtgcgcacccattttacaacgattggctggacgataagctcgccttttacggcgaaggcgtgcgcgcggccgattccatctgggggcgctgtatccttgactatgccaaaggcgcgctggggcatgcggcgtccctgctgcgccgcgcgctcgcgctggcagcgcaggacgaggccgtacaggcggcgtatggcgccgcgctttccggcgatctgttgcagcttgaacaaacttttgccgctgtcacagcgcgcgactgggaccgcgtgcaggaacggttgcgcctgtttacatttgaaaagctgcgtccgctgcgcggtgacagcccgcaaaaaagcgccgtgcaggcgcttcgcaaaagcgcgcgcgccattgtggaggagctgcgcgaccggcagttctgcgcctcgtcggccgagtttttggacgatgtggcgtttttgcggccgatggtatcgctgctgttcgatctgacgcgcgcgtttgaccgcctgtttacggaacaaaagcagcaaaaatacctgatggatttttccgatatggagcagtatgcaatctcgctgcttgtgaaaaaagccggtccgggctatgcaaagacagagcttgcacaggaggcgggcgcgctctatgacgaggtgcttatcgacgaatttcaggacacgaacgccgcgcaggagatcattttccgcgccgtatcgcagaatgaaagcaacctgtttatggtcggcgacgtcaagcagagcatctaccggttccggcaggcgatgccggaactgttcatggagaaaaagaaacgatttgcgccatatgatggaaagacgttcccggccaaaatcgtgctggggaaaaattttcgcagcgcgcaggctgtgaccggctgcgtcaattttttcttttcacagctcatgagcggtgaaatcggcgaggtggactataatcaggaggaggcgctttcgccgggcgcgtcctttccggagggaatcgaggcgggctgtacgctgcgcctgatcgatgcgtcgcagtatgccggggagcttgaccgcacgcagcttgaggcgcgggaggtcgccgagcagatcgcggcgatgctggagcgcggcgaccttgtcgcggacggcggcgtgacaaggcgcatccgcccttccgatatctgcgttctgctgcgctcgcccgcacagaaggcgcaggcgtattttgacgcgctcacgcgccgcggcgtgcccgtctgggcggagccgaaaagcggctttctgacctcgcgtgagatcgcgccggtcgtcgcgctgctgcgcgtgctcggcaacccgacgctcgatatcgattttgcctcggccctgctgtcgccgctgttcggcctgacggccgacgagttgacgcagatccgcctgacggaccggcgcgcgccgctttacatcgcggccgccaaggctgcggaggcgggcgatccgcgcgcggcaaacgcggtcgatacgatcgcacgcctgcgccgcttcgcgtctaacgccacggcggacgcggtgatccgcagaatctatgaggaatgtgactacatgggcaaggtgcaggccatgcgcatggggcaggcacggcgcgcgaacctgctgttgctcgtccagtacgcgtgtgattaccacgcgggcggctacaagggcctgagcggttttatcggctttgtcgaccgcctgatcgaccgcggcggcgactttgctccggcggcgagcatgtccgagcaggccgatgtggtgcgcgttatgagcatccaccggtcgaaggggctggaatttccggttgtgtttctttgcgatacggccaagcggtttaaccgcgaggatttaaacggcaacaccctgctgcactcggagcttgggtttgcgtgtgtgcggcgcgactttgagctgatgaagcagtatacgaccgtaccgatgcaggcgctgcgcctggagcttgagcggtcgatgctgtcggaggagctgcgcgtattgtatgtggcgctcacgcgcgccaaacagcgcatcgtcatcacgggcgtggtgacgaaaccggaggaacggctctgcgcgcttgtgtccgagagtgggacggacgggaagctgccgccgcaccaggtgcgcggcgcaaacgcttacctcgactggattttgatggccgcggcgcgccatccagctctggccgaacgcttcggcttggcgggcgcgccgctggacgcttccgaggcgccgctcaccttcgagctgaaggcggcggccgacggcgaaccggacgcggaaaaaaccagtgaaacaacggcggcctcgccggacgaagcggcgctggaggcgctgcggcgccggctggcgtttcgttatccgtttgaagcacagacaaaaattccgacaaagatggctgtttcacagcttgccggcagcgcgtatgccgcgtcctaccagttttcggcgcgcccggcgtttttgcagggcgacgggctgacgggcgcgcagcggggaaacgcgctgcataaatttatgcagttcgccgattatcaagccgccgcgcgtgacgcttcgggcgagatcgcgcgtatggcgcgggagggatttctctcacggcaggaggcggattcgatccgcccggaccgcgtgcgcgcgttcttttcctcgcggctggccgcgcgtattttttcggctaaacaggtctggcgggagctgcgttttctggcggaagccggcgaacgggagcttggcgcgtacagcgcgctgtttacaaacggcggggaaacggcgatccagggcgtcgcggactgcgtgttcctggaggaggacggtgcggtcatcgtcgattacaagacggaccgcgtcaaaacgcccgacgagctacgcgagcggtaccgcgtacagctcgccctctatcgaaacgcgctgacagaggcgcttggcgtgccggttaaggaatgcgtgctgtattcgttcgcgctgtcctgtgagattgtattgtgaaaggggaatcgccatgttgaatcagcagccggtcatgccgcaagctggaaggcaacccttgagccgcgcggacgcggcgatgctcgcggacgggttcccgaaacagctgcgcacgtccgtctgctgcgtctgtgatcgaatcccgatgcgtacctattataatgtcggctgggcggtgagtgaggatcagctttcctggctgctgccagacgggcaggcgattgcctttccgtaccgcctgtatattcttgacggcgtgccggccggcgttttcacgcctgtgcagcaaacgatttaccactgcctgttttcaagaagctgcgacggctttgtccgggaacgccatattggcgcgcttttggagggggaaccgccgctgtgggccataccctatattttgaaggtatgcgatgagtacgtcgtcgagattttggagctgatctatggccggcttgcccaaagggatacaaaatggtaccggcagttgttcagcttcaacccgcgcgcgctcctgtcaggctacaacaggatgatcagctattggaatgcgtattacaggcaccgttggagcagttaccggcagtatgtgggattccggctttacagggaatgcttcgggtatacagaccgctctggccgtcgggcgcaaaacaggacttgacaggcgggaaccggtgtgataaaatagatcggtaaagaaagtggagcagcaccctgttctcacctcgccgccagcgggcggctggtcaatacagcttgccggcagcggcaaggtatgtttgattgttgagcgtggggaaggtatgccccgcgctcaatttattttgtttgaatcggttttggaggtgtttcgtattagcagcaaggatttgctcatcaacgaggagatcagagacaaggaggtccgcctggtcggtacgcagggcgagcagctcggtatcgtgccgctggcaaccgcgcagaacatggctatcgagaaaaatatggaccttgtgaagattgctcctcaagccacgccgcccgtctgcaagattatggactacggcaagttcaagttcgagcaggcgaagcgcgagaaggaagcccgcaaaaatcagaaggtgatcgagatcaaggagattcgcctctccttaaatatcgatacaaacgattttaacaccaaggtcaaccgtgccatcaagtttttggagggcggcgacaaggtaaaggctgccctgcgcttccgcggacgtgagatggcgcatccggagctgggtacaaacattatgaaacgctttaccgaggctgtggccgaatacggaaatgtggaaaagctgccgaaaatggaaggccgcagcatggtgatgttcatttcgcccaagcccgtaacaaccaccaagggaggaaataaaaatgcctaagctgaaaactcataccggtgcgaaaaaacgcttcaagctgaccaagaacggaaaggtcaagcgcgcccacgcctataagtcccacatcctcaccaagaaggataccaagcgtacacgccgcctgcgccattccacctatgcggacaagacgaatgtggcgacgatcaaactgctcgttccttataaataatcggaagttgacggaggtatacggatatggcacgtgttaagggcgcaatgatgacccgtaaaagaaggaaaaagacgctgaggcttgccaagggctattttggcgccaagagcaagctctttaaaatggcaaaacagcaggttatgaaatccggtaattacgcttttatcggccgcaagcagaaaaagcgcaatttccgcagcctgtggatcaccaggatttcggcggcctgccgcacgaacggcatcaattacagttctttcatgaatggtctgaaaaaagccggcgtggagctgaaccggaagatgctgtccgaaatcgccattcatgacgccgccgcattcacggcgcttgttgaaaaggcaaaggcagccctttaatcttttaacgcccgcggtcaaaacgcgggcgtgtttttatagctttccctccggccgttcaaggccgggggacagtgggattctgcgcgcggtttttgcgtgcaaaaggggggcctgtatgcgcggacagacaattacttcgcgcgaaaatccggcggtaaaacagtatacggcgcttgcgtcctcacgccggcgcaggagagaggatggccgcttcacaactgaaggcgtcaagctgacgcttgaggcgttcacagcgggttatacgcccgaggcgctttttctcacacaggatttgacggacagcgtcaggcggcggctcatgcccgtcgcggctgcgtgccggcgtctctatgagatttcgccgtccgtagcagccaagcttgccggagcggttagcccgcagggcgtttttggcgtgtttatgatgcttgacaacaggacgcaacctgttaaaataggcagtaacggaaaatatctcctgctttcctcgcttcaggaccccggcaatgtggggacaatcctgcgcaccgccgccgcgtttgggacggacggcgtcattttgtcggcggactgtcccgacctttacgcgccaaaggtactgcgcgcatccatgggcggcgtgttccgcgccagggcttgcgtttcggacgatctgtccgcttcgattgccgctctgcgcgcggccggcgtgccggtttgggcggcgatgccggcggaaggctctgtttcgctgcgggatatttcgctgcatggcggcggcgcggtcgtcgtcggaaacgagggcggcggcatcgcgccggagcttgcggcgctctgcgacggtgcgctcacgattccgatggagccgggctgcgagtcgctcaacgccgcgatggccgccggtgtgattctgtgggagatgtaccgttagaaaggaaggcgcggtatgacggacgtggttttctgggcgtggctgcaggatgcgatcgggcttggcagcgtcagggcggaccggatcatccgggagctttcttcacccgaggcgctctatggaaaaagcgcccgtgagctggaggctttgggcatgtttgcgccaaaggagattgagcgcctgcgcgcaaccacgctcgaccgggcgcgggagcagattaagacggccgaaaggctcggttgcatggcgattgggccggatcatcctgactatcccgaagctttgacaaatatcgacgccatgccgtgtatattatatgttaagggttctctgtccggcctttcggacgagcttgtcattacaatggtcggcacgcgcagcgcgaccgaatacgggcttgcgagcgcgtaccgtctttcccatgacctggctgcggccggctgtacggttgtgagcggcttggcaaccggcatcgacacggcgagccacgcgggcgctttacaggcgtccggccgcacaatcgggctgctggcctgcgggcttgatatcgattatccgtcggccagcggcgaactcaagcggcgcatcctggatgcgggcggcgcgcttgtcacggagtttccctttgggacgggagtcaaccgcggcagtttcagcatacgaaaccgcctgctttccggcatcgccgcgggcgttgtggttgttcaggccccggaacgcagcggggcgctcattacggcgcgctatgctctgcaacagaaccgcgatgtatttgccgtgccgggcgagattttcgatccgtcgatggccggatgcaacaagcttgcgcgcgacggggccaaagtggttgtcaacgtatacagcatcctggaggaatatatcggccgattcccaaaacggatcgacgcgcgcacggtcgccgcgaggatcaagagcgcggacagaaacgccgcaaagccgccgcaaaacgcgccgcgccggataaagggcgtcaaggcctgtgcaaagccggccactgcgccaaagcaggccgatgtgccgcgtatggatgacggcgagctggcgaagcggggcgtcaccccgcaggcgcgcgccgtttacgcgcagcttggcgcgcgtgcgctggagcgggatgaattggccgcgctggccggtctgggcgcggctgagacgctttcggcgctcacagagcttgaattgaccggatttgcgcgcgtcgtggccggcggacggtatattccgtcggcgccgggcggcgtttaaagaggattgagaagatacgcgcgtgagcgcattataaatagagcgtattgttctgcgggcggctgtttgcgcggcccgggaaaggaatggtttgtttgtccaatcttgtcatcgtggagtcgcccgccaaggcgaaaacgattaaaaaatacctcggcaaggattttgaagtcgttgcgtcgatgggccatgtccgcgatctgcccaaaagcaagttcggcgtcgacgtcgaccatgatttcacaccgatgtatgtcgatatcaagggcaaggaggatctgatcaaggatcttaaaaaggccgccaaaaaaagcgacgcgatttttcttgcaacggaccccgaccgcgagggcgaggcgatttcgtggcatctggcgcagatgctcggtgtcgatatgaaccagcccaaccgtgtgaccttcaacgagatcacaaagtcgggcgtcaaatacggaatggatcatccgcgcatgatcgatgtcaagcttgtcgacgcacagcaggcgcgccgcgtgcttgaccggattgtcggctataagatcagcccgtttttgtggcgcaaggtgcgaaagggtctgtcggccgggcgcgtgcagtctgtggcggtgcgcatcatcatggaccgcgaggaggaaatccgcgcgtttaagcagcaggaatactggagcatcgacgccaagctcgcggcgaagggccatgccaaaaagccctttccagcaaagctttatgccatcgacggcaaaaagctcgagctgacggcgatcccggacgaaaagcgcgccagggagatcgtcgagtcgctcgatggagcggactatattgttagcaacgtcaaaaagggcgtgcggcgcaaaagccctgcgccgccgtttatcacgtccacgcttcagcaggaggcgtcgcgccgcctgggctaccagtcgcggcgcacgatgaaggttgcgcaggagctatacgagggcgtcgagatcgaaggcatcggcgcgacgggcctgatcacctatatgcgtactgattcgctgcgcatctccgacgaggcggccgaacaggcgaaaatatatataaccgatacctacggcaaggagtacctgcctgcaacgcggcgcgtttttaaaacgaaaaagaatgcgcaggatgcgcacgaggcgatccgcccgtccgatccatcgctgacgcccgaccgcgtcaagaaggatttgacggctgaacaatataagctttataagctgatctgggagcgtttcatcgccagccagatggccaacgccctgctcgatacggtggcggtcgatatcgaagcggccaattgtctgtttaaagcgtccggcttcacggtgaaatttgacggctttacggttctttatgaggagtcgaaggacaccgacgatgagaatacggcttcactgccgccgctggaagcgggcaatgtgctgacgctcaaggagctgacgccgaaccagcacttcacacagccgcccgcgcgctacacggaagcgtcgctgatcaaaacgctcgaggaaaacggcatcggccgtccgagcacctatgcgccgacgatcacgacgattctggcgcgcggatatgtcgagcgcgaaaacaagtcgctcaagccgacggcgctcggagaggttacgacgaagctgatggaggagcagtttgccaagattgtcgacgtgaccttcactgcgaatatggaaaagacgctcgacgaggtcgaggaggggaacgtcgattatccaaagatgctcagcggcttttacgacgattttatgacgacgctggagcaggctgaaaagaatatggacggcacgcgcgtcaaggtgcccgacgaggagacggatatcgtctgcgagctgtgcgggcgcaaaatggtgatcaaaacagggcgcttcggcaaatttttggcgtgcccaggatttccggagtgccgcaatacaaaaaagatcgtcaaggaaacaggcggcctgtgcccggtctgcggcggcaaggtgcttgccaaaaagtcgaagaacggcaagggctattacgggtgcgagcacaatccccagtgccagtttatgacctgggataagccgctctcggaaacgtgcccaaagtgcggggccacgctgttccaaaagacggggcgcggcgccttgatccactgcctcaaggaaggctgcgattatgcgcgtccggtcaaaccgaagaaggaagcggacgaatgacggttcacgtaatcggcgcgggactggccgggtgtgaagccgcatgggcgctggcgaatcagggaatccgggtgcgcctttacgagatgaagccgcagcggttttcgcccgcgcatcacagtgagcagttcgccgagcttgtgtgttcgaattcactcaaggcgcgcaggcttggctcggccgccggtatgctcaaggaggaaatgcgcatgttcggctcgctgacggtcgcctgcgccgaagcgacgagcgtagcggccggcggggcgctcgcggtggatcgcgacgcgttttcggcgctcgtgacaaagcgtatccgcgcccatgctttgattgaggttgtgcccggcgaagtgacggatatcccgcttgaccgtttgacggtgattgcaaccgggccgctcacatcggacgcgcttgcggcgcgtatttcccaattgtgcggcgggacgctcagcttttacgacgcggccgcgccgattgtgacatatgaatcgctcgatctggacagggtgtttttcgccgcgcgctatgatcgcggagacggcgattatatcaactgcccttttaataaagaggagtacgaggcgttttatgaggcgctgcgcaccgccgagccggcgccgctgcacgactttgaccaggctgaaaaacgtgtgtacgagggatgtatgccgattgaaatcatggcgcggcgcgggccggatacgatccgctacggcccgctcaagcctgtcggcctgcgtaatccgcgcacaggccatcgcccgtgggcggttgtgcagctgcgccgcgagaacagcgcgggcacgctttataatcttgtcgggttccagacgaacctgcgctttggtgagcaaaagcgcgtcttttccatgatccccgggcttgcgcacgcggaatttatgcgctacggcgtgatgcaccgcaatacgtttatcgggtcgccgtggctgctcgatgaaacgatgcggatgcgcgagcatgaccggatttatttcgccggacagatcaccggcgtggaaggatacatggaatcggcgatgtcgggcatcctagcaggcaggcagattgcgcggcgcttacagggaaaagagcctctgaagctgccgcttgactgcatgtgcggcgcgctgctgcggtatgtttccgggcctgcctgcgccgatttccagccgatgggcgcgaatatggggcttctgccgccgcttgacgagcggatgaaggacaagcagcagcggtatctgctgatcgcgcagagggggctttctcatctcaggcagacactggttgacagtcaggaggttataatggtatgagggtgattgtggacgccttcggcggcgataacgcgccgcttgaaatcttgaagggctgcgcgatggccgtgcaggaatatggggtcgatatcattgcgtgcggaagcgagcgcgtgatacgcgacgtatgtgaaaaaaataaaatttcgctcgaccgcatttcgatcgctgatgtggaaaaggtcatcccggttgaggtcgactcgaccgagatcgtcaaatcatacgacgactgtacgatggcggtcggactgaagatgcttgccaacggcgagggcgacgcgtttgtttccgcgggcagcactggggcgattgtcgtcggagcgtcgctgtttgtcaagcgcatcaagggtatcaagcgcgcggcgctcgcgacggtgatcccgtcgcagaacggctgctatatgctgctcgacatgggcgcgaacacggaatgccgtccggagatgctcgtgcagttcggcattatggggagcgcgtatatggagcacgtcatgggcgtcaagaatccgcgcgtcggcctgatcaacatcggcgcggaggagacaaaaggcatggaattgcaggtgcaggcgcatcagcagtttcaaaacgcgccggtcaatttcatcgggaacatcgagccgcgcgaccttccgtttacacgctgcgacgtggcggtggctgacggctttacaggcaacatcgtcctcaagctgacagaggggcttggctcgtggttcgcaaaggaattaaaaggcgtattgctgcgcaatttcgtctcaaagattggcacgctgtttgtagccaagggcgttgtggagttcaaaaaaaagatggactacaccgaatatggcggcgctccgcttatgggcatcacacgtccagtcatcaaggcgcacggcagctcaaatgccaaggcgtttaaaaacgccatccgtcaggccaaggaatacaccgagcgcggcgtaatcacggagatcgtcgattcgctcgcgcagctcaaggcgcgcgggggcgccggcctgtgaggcccgggcaggagggcgcgtccgcaagcgcgctggagggccgtatcggttatacgtttcaaaatgggcggtatctcgacattgccctgacgcattcttcgtatgccaatgaagtaaaaaagaatatttccagcaacgagcggcaggaatttttgggtgacgcggtgctgtcaattgtcgtgtcggactacctgtttcatacgtatcatctggcggagggcgacctgacaaagctgcgcgccgcgctcgtctgtgaaaaatcgctgtgggaattttcacaggcgctcggtctcggcgattttctcaaactcggccgcggcgaggagatgatgggcgggcggacccggccatcgattctggccgacgcgtttgaggcgctgatcgcggcgatttatctcgacggcggtatcgagcctgcgcgcagatttgtgctcggttatatcgtcgacgcgctggaaaaccgcgacgatctggcattcagcgactataagacgatgcttcaggagatcatccagaaaaatccggaggagaggctttcctatgtgcttgtaaatgagtcgggacccgatcacaacaaaaagtttctggtcgaggtgcggctcaacagcaacgtgatcggcgttggctgcggcggcagcaaaaaaagcgctgagcaggcggccgcgcgcgaggcgctcaagctgatgggccgatgaagcacgccaacgtttcggtgtttgtgccgcacgcgggctgtccgcatcagtgcagcttctgcgatcagcgcgccatttcgggcgcgcaggccgcgcccgacggcgcggctgtggccgcgctgtgcgcgcgggccgaaggggagcttgcgcagaagggacgaacggcgcagatcgcgttttttggcggcagctttacggcggtaccgcgcgcgtatatgattgaactgctggaagcggcgcggccgtttctcgggcggggcgtgtttacgggcgtgcgcatatccacgcggccggactgtatcgacgatgaaacgctcgatacgctcgcgcgctatggtgtgacggccgttgagctgggcgtgcagagcatggacgacacggtgctttccaaaaatgggcgcggccacacggcagccgatacgaaccgcgcgtccgcgctggtccgggcgcacgggctggaactgggccttcagatgatgacggggctttacggcgcaaacggggcgtctgatctcatgtctgcgcgcctgatcgcggcgcttatgccggcgacggtacgcgtctatccgacgctcgtgctggaggggacgcggctcgcggcgctttggcgcgcgggcctttaccgcccgcagacgcatcaggaggcagcggcgctcggcgcgcgtttgctcgaattttttgagacgcgcggcatgcgcgtgatccgtatggggctgcaagcgcagccgtcgcttgccggacatttgcttgccggaccgtatcatccggcgtttcgggagctgtgcgagggcgcgctcatgtacgaacgcgccgaacgcctgttaagcgagcggccgccgggacggtaccggctgcatgtcgcgccgaaaagcgtatcaaagctgtgcgggcacgggacgcatccggcccagcggctgcgcgctgagggatatgatattaaaatcaggccgaacgccgatgtgcgcggccttgatgtcaaagtggaggatgtgtagtttgcggcttcgcggtttggagatacagggatttaaatcgttcccggacaaaacaaggctgacctttcacgatgggatcaccgctgtggtcggcccgaacggaagcggcaagagcaacattgccgacgcggtgcgatgggttctcggtgagcagtcgacgaaaacgctgcgcggcggcaaaatggaggatgtgatcttcggcggcacacaggcgcgcaagccccagggctacgcccatgtgcagcttacgattgaaaacgcggacggcgcgctgccctatgacagcgccgaggtgagcgtttcgcgccgtctgtaccggtcgggcgaaagcgaataccgtatcaacggcacgagcgtgcggcttcgggatgtacatgaactgtttatggacacagggcttggacgcgacggatattcgatcatcggacagggccgcattgcggagattgtgagcgccaaaagcacacagcgccgtgagatctttgaggaagccgccgggatttcaaaataccgttaccgccgtcaggaggcgcagcgccgcctggaggccgctgaggaaaaccttctgcgcctgcgcgacatcctggcggagcttgaagcgcgcgtcggccctttgcaggcgcaggcggaaaaggcgcgccggtttttaacgctggcagaggaaaaaaagacgctggagctgtcgctttggatcgcgacgctcgaccgctcgcgggcgcttctgcgggaacaggaggacaagctcctgttgtgcagggacgatcatgaccgcattcaggcggaaatggacgcggtggaacagcggatcaacgccctgtatgcagatatgcaggcgctcgccgttgagatcgacgaacggcgtgcgcaggcgcggacgcttgaggaggaaaatgcgaacagcagtgcggacatcgcggtgatgcagaacgatctggcgcataaccgcgcttcaatcgaacagatcggcgcggaactgcggcaggcggatgctgacggcggcgggcttgacgagcaaatccgtacatatgaaacggagattgcggacaaacaggcggcgctggagaaactgcaccgtaaacaggaggagacgcagcaggagattgtgaggctgacagccgcccgcgaggactgccggacacgcgcggacgcgcttaaagaacggcgcttcgggcttacgcagagcatccaggaggcgaagctgtcgtcggcgtcgagcggatcgctgattgacgagacgattgcgcggcttgaggcgcttcgggacgcggcggttgtcggcgatgaaaatgcggcgcggatcgaaaaggagcttgcggactgtaagggattgctcgccgaggtgcttgcggcgtcagaatcgctccaaaatacgcgccgcggttatctgctgcgcgccgaggggcgcggcgagaagctcgacgcgcttaaaaagcagcgcgccgcgctcgatgaacaggcgcgcggcttcttacagaaggcgcggctgctcaccgatatggaaaacagcctggagggctttcagagcagtgtcaaatatgttgtctcacaggcgcgccggggcgcgctgtccggcgtgtgcggccctgtctcgaagctgattgaagtcgatggggaccatgcgctggccattgaaatcgcgctcggcgcggcgatgcagaatattgtcgttgaggacgaaacggccgccaagcgcgcgattgcgatgctgcgctcgagcaaaacagggcgcgcaacgtttttgccgctgacaacggtgcgcggcgcacggctctcggagggttggctttcctccgctgatgggtttgttggtatcgcggccgacctggtgcggtgtgacagccgctatgaaggcgttgtggcgcagcttctcgggcgtatcgccattgtgcgcgacatcgactgcgctgttgcgctggcgcggcgcggtgggtataaattccgcgttgtgacgctcgacgggcaggtcgtcaacgcgggcggctcgatgaccggcggctggacggcgcgcagcgcgggaatcctcagccgcgcgcaggagattgaatcactgcgcgcgcaggcaaaggactgcgcggatcggatggagcgcctcgatggtgaaatcaagaccgttcaggaggagctttccgccgcgcaggcggcgatccttggcgtcgacggcgagcttgccacggcgcaggaggaccgcatccggtgtgaatcggagcagaagcgtttattggctgcgcaggcggatgctgcgcgcgtccgtgagcaggcggccagggagtatgaggcgctcgaagcccggctgcgcgaactgcgcgccgccggcgtatcagccgacgggctgatacaggagctttccggccagcttgacgaggtagcgcggcagcttggagaagtgaacgagggacgcgacgcgtatgcgtcgcggcttgatcaggcgtcggaggcgctcgcgcaggttaacgtcgccgcagcggcgcttgaaaaggagatcgacggagcgcgtctgatgatggaacagctcgccggacagaaggagcaccgccgggagcaggagcgcgcgctgaaggaacgcgccgcgcgtcttgaggaggaaaatgcggcgatccggcggcggatcagcgatctggaggccgcgcgcagggaacggaccgcgcggattgaaaccattggaacggagattgcagagcgcacggcccggcgcaacgagtgcgaatccggtaccgccgcgctgcgcgcggacgaaaaagagatcgccgcgcggcgtgagacagccgcgcgggagctggcgcgcctggaagaaaaaaaggcgtcgatgcagggcgaatacgacgcgatcatcgcgcgcatgtgggacgaatatgaggtgacgcgctcgcaggcggccgaactggcgcggccggtggaggatacgccctctgcgcaaaggcgcctgggggaactcaaaggcaagatcaaggcgctgggcagcgtgaatctgggcgcgatcgaggaatacggagaggtgtcggagcggtatacgtttcttaagacgcagacagaggacgccgagcggtcgcgcgccgagctgctgcggctgattgagcggcttacaagcgatatgcgcacaattttttcggagaacttcactaaaattgccgcgaatttttctatcgtttttacagagctgttcgatgggggcaaagcgtccctgtcgctggcggacccgacggacgtgctggaatcgggcattgatattttcgtacagccgcccggcaagatcattaagaacctgtcggcgctttcgggcggcgagcaggcgtttgtggcgattgcaatctattttgcgatcctcaaggtgcggccgtcgccgttctgcctgctcgacgagatcgaggcggcgctcgacgatgtcaacgtcgtcaaatacgcgcaatatttacgcacgctctgcgataaaacgcagtttatcacgatcacgcaccgccgcgggaccatggaggaggccgacgtgctctatggcgtgacgatgcaggaggaaggcgtttccaagctgctggagctgaatgtcggggagatcgagggcaaactcggtatccaataaaacaggaccgggagggacaatatgggttttttcgggagactggccgaagggctgaaaaaaacgcgcgaatcgatggcgcgcaaggttgacgcgattgtcaattcgtttacaaagatcgacgaggagctgtttgaggagctggaggagacgctgatcatgtcggatgtcggcgtcgcgacctccgcagagatctgccggcggctgcgcgcggccgtcaagcagcgcggcgtcacggacgccgccgaggtcagggagctgatcaaggagatcatcgcggagatgctcgccggcggcgaggagctttcgatttcgacaaaaccgtcgattgtactcgtcatcggcgtcaacggcgtgggcaagacgacgaccatcggaaagctggcggccagcctcaaggcgcagggcaggcgggtgctgcttggcgcggccgacacgttccgcgcggcggcgatcgaccagctccaggtttgggcggaccgcgccggcgtcgagatggtgcgccagtcggaaggggcagacccggccgccgtcgtgttcgacgcgatcaccgccggccgcgcgcgcggcgcggacgtgatcatctgcgatacggccggccggctgcacaacaagaaaaatctgatggacgagctgtcgaaaatctcgcgcgtgatccagcgcgaagcgcctggctgcgacgtcgaggtgctgcttgtgctcgacgcgacgaccgggcagaacgcgctcaatcaggcgcgtcagtttaaagaggccgcgggcatcacgggcattatcctgacaaagctcgacggtacggcgcgcggcggcgttgtcatcggcatccggcaggagcttgaggtgccgatcaaatatatcggcatcggcgaacaggtcgacgacttgcgcccatttaatgcagccgactttgtcgacgcgctgttcggcggccgggaaacggaggcggatgattgatgcaggtgatcgccgcgacgggaaaccgtcataagctacaggaatttgaacggattttcgcgccgctcggcattgagatcgcggcgcagagcgacgtgtgcccggcgcttgcggtggaggagacgggcgaaacctttgctgaaaacgccttcctcaaggcgcaggccgtccacaggctgaccgggaaggccgccgtcgcggacgattcggggctgtgcgtcgatgcgctcggcggcgcgccgggcgtttattcggcgcggtacggcggcgaggatctgccgcacagcgagaagatcaagctgctgctcgaggagcttatacaggtgccggatgaaaagcgcacggcgcgctttgtcgcgcatatctgctacatcggcgcggacgggacgcgcatcgacgcggaggaatgctgcgaaggcgtcatcggccatgcgccgcgtggggaaggcggcttcggctacgatccgattttcatggtcggggataaaagcttcgcggagctttccggcgcggaaaaggacgcggtatcccacaggggaaaggctctgcgcgcatttgcacagaagctttcgcagggatgcgggaatcaataaagaaatgaggaaaccaagatgctgacaagcaaacagcgcgcaaagctgcgcgggctggcaagcacggaggacaccattttgcaggtgggcaagggcggcgttgcggacacgctggtcaggcaggtcgacgacgctctgacagcgcgcgagctgatcaagctgcgcgtgctggaaacctgcccggagtcggtgcgcgaagcggccgagcggctggcggccgcggcgaacgccgaggtggtccaggtgatcggcggaaaatttgtcctgtaccgcagaaacggcaaaaaaccgcggatcgagcttgactgatgcgcacgggcgtgttcggcggtacgtttaacccggttcattgcggccatgtcctgcttgcgcggacatatgccgccgcgctccatttggaccgggttctggtgatcccgacctatctgccgccgcataaggcggacgggcagcttgccggcggttgtcaccgtttgaatatgtgcaggctcgcgtttgagggcgacccggtctgccgcgtcagcgacattgagcttcgccgcggcggcaaaagctacaccgtcgatacgctcatgcagcttgcgcgcgaaaatcccggcgatacgttttacctgattatgggcagcgatatgtttttatcgctgacacaatggtatgactggcagaggattattttggacgcggtgatctgcgcgggcgcgcgcagcccgggacagatgcaggcgctgcgcgccgaggccgcccggcttgagcggctcggcgcgcaaatcgagctggtcgcgctcgaacctctgccggtttcatcgacacaggtgcgcgcgcgcgtgcaggcaggcgagagccttgcgggatttgttccgccgaaggtggcggattatatcatggaaaacaggctgtatcaatcatccaaggggctgttttaaagctcccgttacggggcaaaatgcagcccccgattctcaatgaaagcggggcgcgtcatgatggattatgatttgaaaaagctggacaaacttgcgaaaaagaccctttcggcaaagcggtatttccatacgcagtgtgttgtcaggcaggcgcagaagctcgcgcgcctgtatggctgcgacgaacagaaggcgatggccgcaggctggatgcatgacatctgcaaggagatgccgcgcgatgagcagttgcattggcttgaaaagtatggtatcattcttgacagcgtacagaggacccagccaaagacatggcacggcatggcggcgtgcggctatatcagggagacgcttgggatcgatgatcctgaaattcttcacgccatccgctaccatacaaccgcgtgcggcgcgatgaccgcgcttgacgaggtggtgtatctggctgatctgacaagcgaggaccgcgattataaggatattctgccgatgcgcgcgctggctgaaacggcgctgcgtcccgcgatgaaagaagcgatgcgctttgccctgcgcgatctggtagaacgctcgctcggtatcagccgggatacatttgaggcatataacgcttatataacagatcagcaggctgatctgaaacgtccgtctggaggtgaaacggatgacatctaatgagatggttaaaaagattgcgcgctttctttcggaaaagaaggccaaagatattatggcgcttgaaatccgcgaattgacgacgatcggcgattatttcgttatcgcttccggcggttcggatacgcaggtcaaggcgctgtcggacgccgtggaggagggtctttccgcgctcggcgaggaaccgcggcgcatcgagggctatcagtcggggatgtggattgtgctcgattattacgacgtgatcgtccatatattccacgagcaggcgcgtgaattttacgggcttgaacgcctttgggccgacgcgcccagggtggaactggcgcccggttgagcgcgcctttgacggtccgatgaccggggggccgctggcggctccggttgcaacagaatttgccgcgggcgttttgcggcggcggggagtgtacaaattgaagtacgatttcgcatcgattgaaaagaaatggcaggacatctgggaggcgcagggcacgtttgcggcttcgaacgactatacaaagccgaagtattacgcgcttgtggagttcccgtatccttcaggacaggggctgcatgtgggccatccgcgctcctatacggcgctcgatatcgtggcgcgcaagcgccgcttcgagggctacaacgtcctgtacccgatggggtgggacgcctttggcctgccgacggaaaattacgcgatcaaaaaccacatccacccggagaaggtgacgcacgacaatgtacagcggttcaaggcgcagctcaaaagcctgggactcagcttcgactggtcgcgcgaggtcaatacgaccgacccgtcctattataaatggacgcagtggattttcctccagctctttaaacgcgggctggcgtataaaaaggagatgtcggtcaactggtgtaccggctgtaaggtggtgctggccaacgaggaggtcgtaaacggcgtctgcgagcggtgcggcagcgaggtcgtccacaaggtcaagagccagtggatgctcaagattacagagtatgcgcagcggcttttggacgatctcgatacagtcgattacatcgaccgcgtcaagatttcacagcgcaactggatcggccgttcgacaggcgcgcaggtccatttcggtacgacggccggcgatacgctgaccgtttatacaacgcgcccggacacgctgttcggcgcgacgtatatggtcatctcgcccgagcatccgtatatcgaaaagtgggcggaccgcatcggaaatctggacgcggtgcgcgcctaccagcaggagtcggccaagaaatccgactttgaacgcaccgagcttgtcaaggataagacaggcgtccgcctggagggcgtctgcggcgtcaatcccgtcaacggggccgaaatcccgatttttatatcggattatgtcctgatgtcgtatggcaccggcgcgattatggccgtcccggcgcatgatacgcgcgactgggagtttgccaaaaagtttggactgccgattatcgaggtcgtgcagggcggcaatgtcgagcaggaggcatacaccgactgcgacactggcgtcatggtcaattccggaatgctcgacggcctttcggtcgaggaggcaaaaaagaagatcatcggctggctttccgaaaataaaaagggcgagccgaaggtcaacttcaagttgcgcgactgggtcttttcgcgccagcggtactggggcgagccgatcccgatcatccactgcggccactgcggatatgtgccgctcgacgaaagcgagctgccgttgcgcctgccggaggtcgatagctacgagccgaccggcgacggtgattcgccgctggccgcaatcgacagctgggtcaatgtcaagtgcccgaaatgcggtgcgcctgccaaacgcgagacggacacaatgcctcagtgggccggttcgtcatggtatttcctgcgttactgcgacccgcacaacgacaaggagctggcctcaaaggaggcgctcgactactggatgccggtcgactggtacaacggcggcatggagcatacgacgctgcatctgctctactcacgcttctggcataagtttttgtatgacatcggcgtcgtgtcgacgccggagccgtatgccaagcgaacaagccacggcatgattttgggtgagaacggcgaaaagatgagcaaatcgcgcggcaacgtcgtcaatccggacgatattgtgcgcgattacggcgcggacacgctgcgcctttatgagatgttcatcggcgactttgaaaagagcgcgccgtggtcgcagagttcgatcaagggctgcaaacgctttctggagcgtgtgttcggcttgcttgactgcctggaaccgggcgaagcctattcgtctgcgctcgaatcggcgctgcataaaacgatcaaaaaggtgacggaggacattgaatcgctcaagttcaacacagcgatcgcagcgatgatgtccctgcttaacgatgtctgcgaccatgggaaaatcaatgccgcagagctgaaaacactgctgatcctgctcaacccgttcgcgccgcacatgaccgaggagatgtgggagcgagctggcttcggcgggatgctcaatggtcagaagtggcctgtgtttgatccggccaaatgccgtgacgcgcaggtggagatcgcggtgcaggtatgcggcaagatcaaggcgcgcgtcatggtcgacgccgattgcagcgacgatcaggcgctggctgcggcgaaagcgcgtccggaggtcgcgcgcgccatcgagggcaagacaatcgtcaaggaaattgttgttaagggcaagcttgtgaatattgtggccagataaactttttgtataattttgttgaaaagccacaatagaacatagggtaaattgcttgacaaaggatacctcgtcatagtataataaaagctgttatccaaccacaacggaaggattgacagagtcaggccagacggcgtggggagggaattggtaaatgtcagaaatcagaatcaaggacaacgagtctttggacagcgctctgcggcgttttaaacgctcctgcgcccgctccggcgttcttgccgaagtccgcaagagagagcattacgagaagccttctgtaaagcgcaaaaagaaatctgaggctgcccgtaaacgcaagttcaaataatcaagcgataaaaacggatggggcgcgtccccatccgttttgttcattgcaggttggccgcgccgcggccggaaacgagggaaactatgcgcctgttttggccggaatacaggttccagcgcgcctggcagatcacgcccgaatggcttgcccggcatgggctgaccgtactgctgctcgatgtcgacaacacgctgacaacgcatgacagccccgatatcgggccgcaggcgcgcgcgtggatcgcacagatgcagcaggcgggcgtgcggctcctggttctttcaaacaataaacccgcgcgcgtcgaaccatttgccgagatgatcgggcttgggtgtatcgccaatgcaaaaaaacctcttggcggcggcgtgcgccgcgcgcttgcgcgtctgggagcgaaaaaaagcgagctggcggttgtgggcgatcagatctttacggatgtgctgtgcgcacgcctggcgggcgtgacgtcagtgctggtcgacccaatcgagctggaaaccttcccgtttttccggttcaagcgcgcgcttgaacgtctgatcctgcgcggcgatgcgtccggcgcgcgtcgataaagcatgccgggcggcgatttttaatcgatgggacataaaggggtgtcatcatggaaaaactgcttgtgatcaatgggccaaatctgaatatgcttggcgtgcgcgagcctggtatctatggaaataccggtttggaggcgatcagcgcagaactgagggagtatgccgccgcgcgcggcgtccattgtgaattttttcagtcaaatcacgagggggatattgtcgataagctgcagaaggcgcacaccgattttgacggcgttgtgctcaacgcgggcgcgtacacgcattacagcatcgccatccgcgacgcgatcgccgcaatccgcacgccggttgtcgaggtgcatctgtccaatatccatgcgcgcgagccgttccgccatacgtcggtgattgcgccggtgtgcgccggcggcgtctatggctttgggaaaaacgtctacaggctcgcggtcgacgcgctgctcggcttggaggaggattacaatggaaaacaggactgaggcgctgctggaacggcttccgaaggaaattgaaggcgtattgattacatccgaggtcggccgccgctatttgacagggatgcagtcgtcagccggcacattgctggctctgcgcggcataggagcgtatctgatcatcgatttccgctattttgaaaaagcgcgggccgtttgctccggctgcgaggtgattttgcaggacaagctttacgggcagatcggggaattgctcaagcggcacggcgtccggcggctggcggttgaaagcgactatatgacgctcgcggagtatgcgcggtggaaagagcgcctgccggatatcgagctgttttccgacgcgcgcgctggtgaagcgctgcgcgccctgcgggcggtcaaatcgccgcgggagctggcggctatccgtgcggcgcagaaaatcaccgacgacgcgtttacgcatatctgcggctatatcaaggcggggatgaccgaccggcagatcgcaggtgagctgctcgattatacctaccggcatgggtcggagcgtccggcgttcgattatattgtcgtatcgggcgcgcattcctccatgccgcatggcgtgccgacggacaagaaagtcgaaaagggcgattttatcacaatggatttcggctgcgttgtagacggctattgctcggatatgacgcgcactgtggcaattggccaggtcagcgaggagcagcgccatgtttatgatatcgttttgcaggcgcagaaagcagcaatcgctgcggtgcggccaggcgctgtctgcggcgatgtggacgcggcggcgcgcggggtcatcgctcaggcgggttatggcggcgccttcggacatggtacgggccattcgctcggtctggaaattcatgagacgcccgccttcgctccggaaaacgcccatatatgcgcgcctggtatggtgatcaccgttgaacccgggatttatctggaggggcggtttggcgtgcgcactgagaatatggtgcttgtaacgcaggacggctgcgaggatttgacagcatctgacaggaatttgttggtattatagcaagaattatgtgagaaaggggcttgcattcggcgcctttttcatataaaattagagtgttaaacagggtgatgcgcccaagcctgcgggcaggcgtgtcagaacatttggaggtaactatatgatttctgccggcgatttcagaaacggcgtgacgttcgagatggacgggaacgttgtacagattattgaattccagcatgtaaagcccggaaagggcgcggcgtttgtccgcactaagatccgcaatgtgatctcgggcgctgtgacggagaaaacgttcaacccgacggacaagtatccgactgctttcgtcgagcgcaaggacatgcagtatctttacagggacggcgacctgtattactttatggataacgaaacgtatgagaatatcccgatctcggcttccacgcttggcgacaacttcaagtttgtgaaagaaaacatggatgtgaaggttttgtcgtataagggtaacgtgttcggcgtcgagccgccgtttttcattgagcttgaggtcacacagaccgatccgggttttaagggcgacacggccaccaacgctacgaagcccgcgacgcttgagacaggcgcggaaatccgcgtgccgctgtttatcaacgaaggcgaccatatcaaggtggatacacgtaccggcgagtatatggagcgtgcgtaagcgccgcttttccataaacatttgaaacgaatggaggttgacagccatgacgattacggagagagctgcgtatatcaagggtcttgcggaaggactgggcatcgacgattccaccaaggagggaaaggtcatcaatgcgttggtcagcgcatttgacgacatggcgctgaccgtttccgaccttgaagctcaaatcgacgaactcagcgagcaggtcgatacgattgacgaggatctcggctcactcgagcaggatttttacgagcttgatgacgacgactgcggttgcgatgactgcggctgcgactgtgacgacgaggattgcgcagacggcgacatttatgaggtctgctgtccgacctgcggcgatatcgtatgcatcgattccgatatgcttgaggaaggccagacgacctgccccaactgcggcgagcttctggaattcgacctcgacgatgaggaagatggggacaaggcgtcgtccgagcaggacggcaagtaattgttgtctgcatatcaagcgtttggctttggaccggaagacaccccgcctcccgcggggtgttttcgattgattcactgaaaggatttttgggcttgtcgaagcgtgaaaaactgggcagggcggtcgccggccttgtgatcgcagcggtcctgttggctggcctggcgggttttgttgccagggcattggcgcagcggcgggtctctgagcgcgaacgcatggtaacaaccggcgtggcgtttattatggatacgttcgttgagtatgaatttttcggcgagaacggaccgcaagccaaggatgcggtcgacgctgccctgcgcgacatcgaaaacaggatgtcgatgtacatagatgattcggagattgccgcgctcaatcgaaatgctggaaaggcgttcgtcccgctttccgaggatacgtatgagctgttggaacgctgcgcggcgtatggagctgaatcagacggcgtttttgacgtaaccatcgcgccggtggcgcaggtttgggagatcacacgcggccgcgtttttatcccggacagcgagcagatcgccagccggctggctctggtcgattaccgcgatattctgctcgatcctgagacgcattccgcgatgctgcggcgtgagggtcaggccgttgatctcggaggaatcgccaagggatttgcatgcggcgcggcggaccgtatcgcgcgggagaacggcgttgaatcgggatttatttccatcggcggcaacatcatgacaatcggccaaaagcctgtcgcggatcaggctggcagaacagtgagacagccgttccggtttggcctgcgggacccgcgcggcggtgaaaacgattatattgccgcggtcgtcctggaggacaccacgatggccacatccggcgattacgaacgctattttatgaaggatgacgttcgttatcaccatatcctggatcccgcgacgggctatcccgcccggacggacctgatgtctgtgtctgttgtttcgcaggacggcgcgtttgctgatttcatgtccacatggctgtttataaagggccggtcgtttgtgctggagaggctcaacagttttgactgcggcttgatcgtgattgatcaggacaagaatgtctatatttcagaaaacatgcgggagcgtgttgtcccggccgacaagagcggcgcctatacgtttgtatccggagggacggcatgaagtaccgggcgtcgcgcgcggcggcaatggggcttttattcgcgctttcgattgttttaagtttcgcggagtcggccttgataccgcccctgccggttccgggtcttaaaatagggctttccaacatcgtgacgatgtactgtctgttctgtatgggccggcgcgaggcatatacaatcgctgtgctgaaaagcatgtttgtgctgcttacacgcggcgctgtcggcgccgcgatgagccttgcaggcggtctggcgtctgtgacggtgatgctgctgctcggcgcggggcgtgaaaagcgcagctttctttttataagcatctgcggcggtttggcgcacaacgccggacagctctttacggccgcggctgtgctgaaaagcgcaatggtgttttattactttccggcgcttgccctctttggaatcgccatgggggtattgacaggagtactgctgcgcagtctgatgccgcattttaaacggatcttcttttgacgccattttggagtcaactgacgataaagcccgtatcaaagcggcccttgaacggcccgcctgcttgttgtgtgggcagggcgggaatcaaaggccggtttacgggaggaagctgccggggcatggcggtttctgaaatctctagaggaggcaatatgggaaaatgagtgttttgcagaaaacgctgaagggcgcgcatgtcgcgcacttcaaaaacacggaaaattgtccgggcgttgagctgccgcttcccaaggaagtatgcatttcaatgtcgcagcacatgggtccgccctgcaagccgatcgtggccaagggcgacactgtgaaggttgggacaaaaatcggcgacagcgacgcatttttaagcgcgccgatccattccagcgtatcggggaccgtttcggcgattgaggagatcgtcacatcgaatggcgggcgcagccaggtggtgatcatccagacggacggcgaacagacggtcgatgaaaatgtaaagcccccggtgatctcgaatcatcccgaatttgtgcaggcgatcaaggagtcgggccttgtcggtctgggcggcgccggtttccccacgcacatcaagctgaatcccaagaatctctctgaggtggatacgctcgttgtcaacgcggccgaatgcgagccgtacataacgtccgactaccgcacgatcatcgagcgtccgcaggatgtgctcgacggtattgaggcgatcaagaaatatgtcggtattacacaggtcaagatcgccattgaggacaacaagccccaggcgatcgagatgctgcgccgtctgacaaaggacgacagcagcattgaggtgtgcagcctgcacgcgatttacccgaagggcgctgaaaaggtcgcggcctatgagacgaccggacgcgtgatcaaagaggggatgcttccggccgacgcgggcatcatcgttgaaaatatcacaacgaccgcctttatcggccagtacctgcgcacgggtatgccgctcatcacaaagatgctgacggttgacggcggcgcgatcgccgagccgaaaaacgttatcgccccgatcggcgcgcatttttccgatgtgattgccttctgcggcggctataaacgcccagccaaaaagctgatcatgggcggcccgatgatggggacgcttgtgtttgacgccgcgtaccctgtcctgaaaaacaacaacgccctgcttgcgtttgacgagtcgcagaccgtcgtggagccggaacatccatgcatccgctgcggccgctgtatgcagaattgcccgtaccgcctgatgccgcgccagatcgagaaggcgtatgagagcgagaacatcgcaatgcttcaaaagctcaaggtgatgctgtgcatggagtgcggctgctgctcatttgtctgccccgcaaagcgcaatctgaccttcaccaacaagatggccaagcagatgctgcgcgcggcgaccgcgaaaaagtaaggataggagggtattgttttggctacgaatgtaatggaaaaccaggagcagacgcaggaacaggcgaagcttatgatcaccccgtccccgcatgtgaaggatggcatctcgacgcgcaaaatcatgctcaccgtctcggtagccctgatgccgtcgctgatcgcagcggtctggttctttggcctgcgcgcgctcgcgctgactgccgtctgtgttgtgttcagcgtcctgtttgagtatctgtttaataaggtgacaaagcgcgagcagaccatcggcgattgcagcgccgttgtcacaggcattattctttcgttcaacctgccggttacgcttccgttctggatggcggcgttcggctcctttatggcgattgtcgtcgttaaatgcctgttcggcggtatcggatgcaacttcgccaatccggcggcgacggcgcgcgtgtttctgctcgtgtcgtttggcggccagatgacgacatgggtcgccccgcgcggcgttgacgcgatggcgacggcgacgccgctcacgctgatctcagccgggcagacggacgcgctcccctcgctttggcagatgctgatcggtcagcgcggcggttcaatgggtgagacctgtgcgatcgcgctgatcatcggcggcgtgtttttgatctggcgcggcatcatcggatgggaaatccccgtgacgctgatcgcaagcatctttgtgtttgcgctgctgttcggccaggacccgttttatgcgatcctttccggcggcgttatgatcgctgcatttttcatggcgactgattattcgaccagcccggtaacaacaaagggaaaggtcatttttgcaatcggcatcgggttcatcaccatggtcatccgttctttctgcaactatccggagggcatgtccttcgcgatcctcctgatgaatatcctgacgccgcacatcgacagcctgacgattaccaagccgttcggcgctgtctttgagcagaaacagtaagggggcgcgtgtatatgaaactggcaaaaccgattattgttctgaccctcatctgcgttatatcttccgcgctgctcggcgcgacctacacaattacaaaggatacgatcgacgcagccaccaaagcggctacggacgcggccatggcggcggtgttgccgggcgccggcagctttgaggagatcaccgtcgacggcgtcgagggcgttctgctcgcagccaaagagtccggcgggcttggctacgcgttccaggtgcaggataagggctttggcggcgcgtatgttgtgatggtcggcatcggcgccgacggaaagatcacaggaacgcagctgcttgacaacagcgaaacaccgggacttggttccaagacgggtgaagcctcctttaccgatcagtttatcggtaaggattccgcacttgagggcgtcgagacggttacaggcgcaacgatttcctcaaacgcgtttattcgctgcatcggaaccgcttatcaggcgtacggagctgtgaccgggcagtctgttgattcgactgccggcgctacggcagaggaggaggcgtaaatcatgtctgataaaccaaagacgaattattggaaaattctcacaaacggcattctcaaggaaaatccgacgctcgtgctgatcctcggcacctgcccgacgctggctgttacaacccaggcggtcaacggtatcggcatgggaattgcggcgatggttgttttgatcggctcaaacgtcgttatttcgcttttgaaaaaagtaataccggattccgtgcgtatcccgtgctatatcgtcgtcatcgcggcgtttgttacgatcgttcagtttcttgtcaaggcatacgccccatcgctcgacaaagcgctcggcgtttatctgccgttgatcgttgtcaactgcatcatccttggccgcgccgagatgttcgctaataaaaacaccgttctcgcctccgctctcgacggcgtgggcatgggccttggttttacgctggcgctgttctgcatgggttcgatccgcgaactgatcggaaacggcacctggatgggcatcacgctgacagccaacctgtgggatccggtcatcgtattcctgctggctcccggcggcttcctcgtatttggatttttgatcgctgccgtcaaccatttgacgcacggcaaggcgatcaagaaaaaggaattcggctgcacaggctgtccggcggcttccgcatgcgccgctgtccgggaaggaggtgctgatcagtgaagcaatatttgattatcattgtcagcgccgttctggtcaataactatgtccttgcgaagttcctcggcatctgcccgtttttgggcgtcagcaaaaagctggattccgcattcggcatgagcgtcgccgttacattcgtcatggcgcttgcgacagctgccacatggccgatctatacatatctgctcgttccgaacgggttggattatttacagaccattgcgtttatcctgattattgctgcgcttgttcagttcatcgagattgtgatgaagaaatatattcctgcgctgcataaggcgctcggtatttatctgccattgatcacgacgaactgcgccgtgctcggtgttacgatcctcaacctcgacgaaggctacaatttccttgaatcgatggtcaactcgatcggttccggtcttggctttatgctggccatggtgattttctcgggcgtgcgttcccgcgtagacgctgcggctggaagcattcccaaggcgtatcagggcatcccgatcacactgacggcggctgcgatctgctctgtcagctttatgggcttcagcggaatcgttgacggcctgttcaaataatgggggtggggtttcatgatgacttcaataatgttcccagcggtcatcgtaggcggcatcggcttgatctgcgcaattgtgttggtcgtcgcggccaaggtaatggcgctgcccgccgatgaactgtttgacagtatccgcgccgagctgccaggcgccaactgcggcgcctgcggctacgctggatgcgatgattacgccaaggcggtcgcgcacgacggcgcaaaaacaaacctgtgcgtgcccggcggcgcaggcgttgcggcgaaggtgagcgcggcgatgggcgttgcagccgaaagcgtggaggcaaaatatgctgttgtgcgctgttcgggaaactgctatgcaactgacagcgtgatggactacaagggcaaacagagctgtgcggcctgcaacttcttttatcagggcaagggtagttgttcgcatggctgccttggttatggtgattgcatcaatgcgtgccagtatggagccatttcgattgtcgacggcatcgctgtgatcgacaaggccgcctgtgtcggctgcggcatgtgcgcaaaggcatgtccgaaccaattgatcacagttatcccggcttccagcacggtctatgtcgggtgcagctcgcacgataaaggcgcgtttacgcgcaaggtctgcaagaacggctgcataggctgtaaaaaatgtgagcgtacctgcgagcatggcgcaatcaccgttacggacaacctggcttcgattgatccggagaaatgcgtcaactgcggaaattgtgtgaccgcttgcccgaccggcgcgattgtcacctgcgaatcccgctgcgaggcgatcgtcaagggcgcgtaatttgcagcgttctggggcttgaaaagtaataacgaatgaggggctgcgccgctttagcggcgcagcccctcattcgtttgttttctgacgtatccggcgcctttggtcaggcggcattcaatacagtgtaccggcaaaaaaggcatcccggaaccaaacgtccaatacctcaaaggaacgtccgttcaagccgtttaatacgcctgcgtccgactggaaatgaaaggtcagcttataagcgcaaagcgcctgatgcttcaatcccgttttgtggttatcgcggtttcgcccatactttgcatcgccgagcagcggatgcccaatatgcgccaaatgcgccctgatttgatgagtgcgtcctgttagcagatcaatttccaaaagtgaaaggcggtccttttgcgccacaacgcgataatgtgtcaggattgtgcgcccatcggggatcggatggtcgtaaacagcgaccgtattggtacgagcatccttgcgcaggaaggcttttaatgtgtcggattccttcggcatcgttccgtgtacaatgcacaggtagagcttttgcagctcgcgcgccttgattttttcattgaggatgcgcaaagctgcggcatttttcgcagcgatgacgataccggcggtattgcggtcaatccggttgcacagcgccggtgcgaagctgttttcctccgccggattataaacgccgcagttgtaaagatggtgctgtatacggttgataagcgtatcgctgctctgatgctcgtcctcatgaacaaccaaaccggcgggcttattgacaagcaggatattttcatcttcataaataatatcgattgcggctggagagcgcaggaaggagaaggcgccgtcgcggctgtcaaaaaaagaatcgttgagatagagcgtgagttgatcgccggtgcaaagacgcgtcgaaatttcacagcgttttccattgagtttaatacgtttggtacggatcgctttatacagcatggactgcgggagcagcggaaccgcttttgtcagaaacttatcgacacgttgtccagcgtcgttaccattgatttgaaattccctcataacatcctccaagctggatttcattttggaccggttttgccatattgccataaaaatatgacagagctggccgtctgagcaaaagcgggttgagttcgtcctgatggcatattttacatgccgcttcgcagacatggtaaaataaccgcagggcggtcattttaccttttatggccggggcgatccgcgggcgcagcccgcttccgccctgatggccaattttaccatgccgcttcgcggacatggtaaaatatgcgcaatgcgcaatccgctgcaaagcagcggttgccgacggatggcggctacaaacggctttatcgtttgctctgcgcatattctaccatgaagtaaccattgcggcaagcgatgaagccggctggatgcttgaaaattggacatgctgcggatataatggaattgagacatcaagaaatgtggtgacacgatggcaaatctgcatgaggggcatcgtcaacgcctgaaagagcgtttcctgcgtgaaggactcgaccattttgagccgcataccgtgctcgagcttctgttgttttacgctgtaccccagcgtgatacaaacgaattggcacatcgtttaatcgcacggtttggctctcttgacgctgtgttcgacgcggcttttgatgaactgtgcgcagtggaggggattgggcgcaacacagcaaccttgctcaaactggtgcccgatctgacgcgtcgctacctggacagtgcggatcatgagcaggtgctgcttacgtccgtccaggcgattggggattttttgcgtccaaaatttttgggacgaacaaaggaaatggtattcctgctttgtctgaacaacaagggcggattgacctacggcgattttatcgcggagggaacaatcgattcagcgccgatgtattcgcgtaccattctggaagccgccatgcgcagccgtgctgtgtccgttattttggcgcacaatcatccgcatggacttgccgtgccatctaatgctgatctggcggcgacggaaagtgtttgccgcgcgctcgcagctgcaaagatccgcctgcttgatcattttatttttgcaggacaggattatatttctctgcgcgattcaggctttattcgtgtggaaggcggcgtttaatggattgattcaaaaaagctgtgtaaatgcagctgcctataaaatagcgtcaaaaagtgagctgaaataggggagttgtcgaacagaatgcaaaaaagacaggtgaaaagtggtcgcttttacctgtcttttcttcctgctgcacatcaaagcgcggctttcaagggggaggatgcccatatggcaaaattattttaaggcttcactttgtgatttaaccgttctttagcttcttcgatggtttcctcctcctttgtgagataacgatcaacataagcgccttcaattttcgtaaaaatgtgggtgaatggcggttgcaaggagacgtccgaagaaaaagagagtattgtccgcagtgaatatcaaggacgttcggcgctgtgagaaccagagcaacgcattgcatattgaaagatctacagtaaaatagtgttttgtccaatgatcggattgacaaaagacatataaagatataatataaaaacagaatatttttaaaaatacgaatagaattgctttttctgtccatttgtatggaacacggaatcgggtgagagtcccggcgagtcggtcactgtgatgcttccaagagaagataagtcagatacgtgggaaaaagcggtgcttctgccgcaaccggaagacacgggccatattggcgtagagcgatctgcgcttttttctgggcgtgcttttcttaggaaggcacgtccttttatattggcattttacaatccaataaagcaaattaggaggaatacagatgaccttgcagcaattgaaatatgcggcagccatagcggcagcgggaaccatcagcgaggcggcgcaggctttgtccattgcccagcccagcctcaccaatgccatgaagaagctggaaacagaattgggaatccgtatttttatgcgtaccaataaaggcgttgcgctttctcgggaaggagaggagtttttggcctatgccagccgggtgacagaacaggcgaccctgctggaagaaaaatataaaggcagaaagattggaaaacaaagcttttgtgtatccgcacagcatgactctttcgcgatgaatgcttttgcggatttgatcaggctgtttggaaacgaggcatatgatttttatttgcgggagaatcaaaccgacgagatcatagaagacgtggtaaaactgcgcagtgaaataggagtgctttgcctgaacgaatatcaaaaaaaccgcattcaaaggatattaaaggatcgggaattgatgtttgaatgtttatttgttgcaagtccatatgtatgtgtcagctcaacaaatccgcttgcagagaaacatgctgtgaagccggaggatttggaaccatatccctgtctctcctttgaacgcaagacacgcgaagccgtttgtttgacggaggagatcttaaatacattgaaacgcaaaaagaacatttgggtaggagatcgggccaccttgttcaatttattgattgacttgaatggctatacgatttgtcatgggatcattggagaagggtataatgaaaaagacattgtagcaattccactgcttatagaggatgcggtggaggtcggttatatcgtcaatcaaaaaatttctcgcggcagcctttgctcccattatattgaagccttgaaaaatcatgcgcagcaagcgcgcctgtctccgtttcataaaatgcctctttactattcagcataaggagtcatgcgtgtaatctatatcagagcatatttcgggacacctctgatttgctgtagggaagtctatttcttgacttgcactgataaagtggatataattaaaaaatcagcaattatattcgatcaggatgtccgggccacagacgaccggacaacaaatttttacagatcgctgaacaatcttaaaaatatatgaagcttcagatgaggaaacgagtgggaatctcgtacggtcacgccactgtgtagcggttataccgcaaagtcaggtcgtcatctggagtcatatccatcgtttgagcttcgagggaaagggagatggatgcgggagcctatggaattgttccggacaggcggaatataataggcttttgggtattggcccctttccgatggaggaaaggggcttttttagctgttttattgaggcgggcggtctgtttggaaagggggctatccccctttttcaagaatggctggggcgcacaataaagaaaaatataaaaaacaaaggatgaggtggaagcaatgaagaaaaagaaaaccagccggattattgccgtttgtatggccaccatgctgctgattggcagtgttggatgcagcagtgcggaagaaggagcgcgggcgtctgtgccgggcggatcggagcaggcaagcagtctgtccacagatggcgcacagaacgaaaaacctaccgatcagaatgatcagattgttatagctggctaccgcgatccaggccgcggcacaaaggatccctattatacaaacgtaaatctttatgtgtgggagccgttgattggagaaaccgaccagggggagcctgaaccgcgtctcgcgaccagttgggaccgcaatgaggacgccactgtgtggaccttccatttgcgggagggtgtccaattttcggatggcgtgccgtttaacgcggacgctgttttgaaaaattttgaacggtaccgcaacatgggggtggtgtcctccacatttttcgcctttgacgtggacgctgtatatcccggcctccagtcggtggaaaaggaggatgattatacggtccggctgacctttgagaacccgatcccgacgctgccctatacaatgattaatttcggctgtgggatgttcagcccggaatgctacgacccgcagacgggtgaatttaaggaatactgcgtcggtaccggaccgtttgtgatttccgagcatgtaccggacgaatatatcacattggagcgcaacgaaaaatattatggggatcccgctaaagcagcaagcatcaaaatccgtattattccggatcatgaaacgaggatcgccgccctgcgttccggcgagatcatgggcgtctatgacaacaacgcaattttgccccaatcggccaaagagcttggggaagccggcgggtttgtggtttcctccgcgctttccgcaaatatccagtatctcaatgtgaacaatcagaatttcccctttaacgatgtgcggatgcgccgggccatgagtatgatcatcgaccgcgatacgctgctcaatgatatctactgtggctatgggaaaacaaccgtcaatgtcctcagccccatgtccgtgttttatcaggatatccagccggaatataacccggaagcggccaaggccctggcggccgaagtgctgcaggggcagacgcctacggtccggctgctcaccgcgtcgacgtataaaacagatgcggagctgatcagttattggcttggggagctggggctgaacgtacagattcaggtattggacagcgccgccgtctccgccgctttgaaggagcgggattttgatctgtccatgggctttaaggggatgaacaacgccgagcctgaaaccatgctgcgcggctttttgcatacggacgggtttatgaacaatggctttgccatgagcgggtatcacaatgaagaagtggacgctctgctggatcaattgaaggacacgtatgatgaggaggaacgggcggcgctctttaaccagctccagaagatcggagcggaggagctgcctgtgatccccctgatcgccgttaccacgctggtggttcacagcgaccaggtcacgggctatgacgccaaatttaccgggattacacttcccgaagtcgcctgggtcagttgaaatgctgcgctatattgtccggcgtctgttctccgccgtgccggttctgtttggcatcacccttttggcctttcttctgggaattttaagtccgggaaatccggcggaaatcctgttgagcagcggcggtgaatccgcctatactgcggagcagttggcggaggtggaacgtcagcttgggctggaccggccctatccccaacagtatgtgcgatggataggcggcgtgcttcagggggactggggtgattcgtttcgaacgaaggagcctgtgcgtgaggagctgttcagccggtttggcgtcacgataaagctggcggccggcgcgctgcttttgactgtgatggtgggaattccatttggcgttttaagcgccgcccgcgaagggggactgatggacaggctcagccagtggggcagcatcctgctgctgtcagttccaagcttttgggcggcaatcctgtcggttggcatttttgccgagcagcttcattggctgccaacaagcggccaggagacgtggctgcatcttgtgctgcctgcaatcgtgttgtctttttccacggttggcaccacgatccgcctgacgcgctccacagtgattcgggaattgagcagccagtatatcacagcggcgcggggaaagggcatttcccaacggctgatactcggccgccacgccttatccaatgcgattcctccggtgctgacgcttttgggaaattatctgggcggtattctgggcggttcggttgtggtggaatcggtgtttgccatcaatggaattggaaaatttgccctggattcaatcgccgtccgcgactatccagcccttcagggctatgtgatgatcaccggttttacatttgtagccatccatctgctgacagacctgttaagcatttggtttaatccgcagatccgcttggggggaggcgcggcggcatgaagcgaaaaagtaaaatcgatccattggcggccctcgcgctttgcctgctgggccttctgttagcggggagcctgttggcgcctgttctggcgccttatccccccacacagatcaatatggcggagcggcttcagggaatatccgccgcccatccgctcggcacagataccctggggcgagacctgttgtcacgcgtgctgtacggcggccgcgtatcggtgctgattgcggcagcagccaccgcgctttccatgctgttggggctggccgtcggattgatcgccggttatctgggcggatgggcggacggcatcatcacctggtttacgagcatcttccagggcctgccctccaccagcgtgatgatcgcccttgccgcgattttggacccgggcgtgtccagcctgctgctggcgcttgttctgacatcgtgggcaagcttttcacgggtggtacgcagcagcgtgctgcgtctgcgggaggaagcatatgtggagggggcgcggtgcctgggagcgggacggctgcggatcatcacccgctatctgctgccgaatctgctgccggagatcgcggtgctgtttacaacccgcgtgggaggtgttgtcctttcggtcgcctccctcagttttctgggactgggtatccagccgccgacccctgactggggggtgatgatcagcgaggcccggaccagttttcggacggctcccatgctgattctggcgccgggcgcgtgcctgatcatcctttcattcggcatcaattacctgggggaagtgctgcgtgcacattttgatattcggggccgtacccggcagatcgattaggaggggcatatgggatcggatattctggtcaaccgtctcacagttgcctttggagagggcagtgatgcagctgcggtcaaaaatgttacaacgcggtttctctccggacaggtgacgggcctgattggggaaagtgggagcggtaaatcggtattgggcatgtccattttaaggctgctgccttccagcgcccgcctcagcggcgcaatcgaatttgacggggaaaatttgctgtctctttccgcgcgggagatgcaggccctgaggggaagccggatcgggctgatcccgcagagtccgggggattcgctggataaagcgctgcgtatccgcgtccagttggaggaggctttgctggcgcacagcgggcagggccgtaaagaggcgcgccgccgggcggtggagttgctgaaggcttttcactttgaagatgtcaaccgggtgatgcaaagctatccctttcagctcagcggcggtatgcagcagcgcgtcgtctcggcgatggggctttcctgcggcccggaatggctcatcgccgacgaacctacaaaagggcttgacgcggtgctgcgtgagcaggtgtacagcctgcttgacgatattgcgcaaaatcatatcaaaagcatgattattattacgcacgacttgtccctggccgcgcgtgtctgtcacagactgctggtgatgtatcagggacgcgttgtggaggaggggccggcgggggaagtgctggcatccccgcttcatccatataccgcgggtctgctggcggcaatgccgtccagaggaatgaaccccctgccgccgccggacccgtcggttcccgccacaggctgtccctttgccgcgcgttgcacacagcggctggaccgctgtaccggcactgtgccgcctatgcgggcgcagagcgggcggaaagcgaggtgctatctccatgctgacggttgaacatctcggaaaaacctttgtgtccggctttggacgcagggtaaaagcggtgcgggatgtttcgtttcatatcaaagcggggacaacctttgggctgatgggaaacagcgggtgcgggaaaacaaccctgtccaggatgatcctgcgcctgcttgacagcgattgcggccgcatcctgtttgacgggcaggatatcacacatctgcggggagcggcgctcaaagccctgcgctgtcaagtgcagcttgtatttcagcacccggaatcatcgctcaacccgcagatgaccctgcgcgagaatcttttggagcctttgcggatccatcgcctgtatgataagaaccagcgtgaacgacggatccgggaacggctcgagtgggtcggtctttccgaaacgctgctcaaccgctatccgcatgagatcagcggaggcgaagcccaacgggcggtcatcgcacgggctttggggttggatgtgcgcttttttatcctggatgaacccacatcgatgctggatgtttccgtacaggcacagattatgcgcctgttttccagtttgcagcggcggctgggtcttacatatcttttgatctcccacgatttggaggttgtgcgttggctcagccaggaaatcgccttcatgcatgagggggctattgtagagcagggaccgacagaacaggtattggcaaaaccctctcaggaattcacaagaaccttgatccgaagttttcaagccatgtaacgtcggccttaagtataatcccccggctaaaaagccgggggattatacttgtctgccctgtggtggaatttattcctgttcaagcagcttcagtacctgctgaacattttttcttccaaatgatatcgttttttcattcagcaccaagcaggggacactcatcacctgatatttctcccgcaggtcaggaaagtggttcaaatcataaacctcagcggtgatgacatcgttttcggccgcgatccgctgagatgcggtgacaagttccgggcacatggtacaggagagggatacgagcacccgcagggccattggccggcggatagttcggatttgcgcagccgtgtcggggtctaagggctggccgggacctgccgcgttataaagtcccaggataaagctggtgaattcatggccgcctggaacgccgtggaaagcaaggcccgtccagctcccatccggccggaaaatccggacgcagggcagatgggcaacctcgctgtcctgcgcagtttccatggtcagcatctctgtcagagcgcacaattgttccatatactgccgcagctccccggagagcggcgtaccgtccagatagagccgcagaacaagcggcgcggccatccggctaaacacagttttaagctgggccagcatatcggcggaaaatatgccgccttgtatttctgctggcgcatcggccggcgcggcgtcactgggcggtgtggaaaactccggccgcagtccggtcctgcgctgcgccgcggctgcccatcgctcaagctctgtggcggctaatgccccatcgcccacggcggtgaccacctggcgcagaggcttgacgcacacatcgcccgcagcgtacaggcctggcacggttgtactctgggatcggtcggtgatcacataaccatgctcgtccaattgggtaagatcgcgaatcaattccgtggctggctcataacctgcaaagacgaatacgccaaaggtatccccctgcggaggtctgtattcggtagtctctccagtggcggtgttgtggtagcgcaggctgcgcagggcgtcgtctccagacacttcatccaccactgtattggtgagtatagtgatcttctcatggttgcgggcggcgtctgccgtggccttggcgcaggaaaaatcggcctcccggataaggatagtcacatggcgggcgtacttcgtcaaaaagacgctttcctcagcggcggcaaagccccctccgaccacaaatacatccttaccggtaaaaaattccccatcgcaggtggcgcagtaggcaactccccggccacggaacgcctcctctccccgaaatcccaccatccgggggtgcgccccggtggccagcaggacgccaaagcactgtttctcacctcggctggtttgaacgcgcttgatatctccggccagttccagacctgtgacctcggccaacagaaattcggccccaaaagattgagcttgacggcgcatggtttcggtaagcccggcgccgctggcccgttccacaccgggatagtttacgacctctgaagtgatggtaatctgtccgccaaaatgctctttttcgactacgagtacccgatagcgcgcacgagccaggtacaaagcggcggtcaaccctgctggaccgccgccaataacgacaacatcatagagctgctttgtatcaatcatagcatgacctcaacggcacggacaaccggcctcctcagagctgccccaccaagtcaaggctgggcttcagagtttcggatccaggctgccatttggctgggcaaacttcatctccatgggcggctacaaattggctggcctgcacccggcgcaacagttcatcagcattgcggcccacattgccggcaagaacttcataggctacgattttaccttcgggattgacaataaagctgccgcgttccgctacaccgtcagactcgatgtataccccaaaatcccgcgccaaggtatgggtggggtcggccagcattggatattggattttgcggatgcgctcggaggcatcgtgccacgctttatgaacatagtgcgtgtcacaggaaaccgcatagatttcacagcccgcagcttggaacgaggcgtacttgttggccagatcctccagctcggtagggcaaacgaaggtaaaatccgcggggtagaagaaaaagacgctccacttaccaagtatatcctcttttgtgacggtacggaatgcgtcgttctgataggcttggaccgaaaaatctgaaatttctttttggatcagggacattatcaagacctccagtataatgatatcagttagctatagctaactgatatcattatactggagcattatcgtggttgtcaagtatttcctgaatccgctgcttacaaataatagttttctttttctgtgcgaaaggggagatgtgtggccgagttgctgtttgcgattttatagctcgcggcaattgcaaaaataaccgccctttcctgagaaagtaagcggttatttttgcaatcagggctaaccgtttgttggcagcgcctctttgcttttattatacttgtccccgggatatctatcaagccgctgctgcttaagccggcagtttattatgaacaaaagccgcggggattccttgataaagaggcgtcaataattgggcgggcgtcatgcccgttccgcggctgatacaatcgaggatttccaaatttgtatggttctccgcccactcgattcttacttaggttttgacatcgattccgatttggagcgccagattctcctggctgattccattgatcgcgcggtattccaaaaggttacacgccaaaataactctggatttatcgtattcacaattatttcttcttgcctcgtattacaacgatttagggaaatatttgtataaattagtcgcgttttcgcacagcggagtcaggctgatgagagtattcgccggtctgcctttttgttttgccgtttgctctgcatatcttattccagattctttgccaaccattacttgtagaattttgcaggctttcagcggtagaataaaggtatgaaagcatcggaaagaacgattttacacgtcgattgtgacgccttctatgcctcagtggaatgcttgtacaaccctgccctgcgtggaaggccggtggcggtggtgggtgatcctgagctgcgccacggaatcgtactcgccaaaagccaggaggccaagctgtttggtgtccagactggggacgcgctttggcaggcacggcagaagtgcaaagagatcacctttgttcccgcccattttgagaaatatctttctttttcccgtatgaccaaggagatcttttcggaatattccgaccgttgtgaatcctttgggctggatgagagctggattgacctgaccggctgtacagagctgttcggggacggaccggcagtcgcaacccaaatccgtcggcggataaaagaggagctgggaattaccgcctcggtaggggtgagctttaacaaggtctttgccaaattgggcagcgatctaaacaaaccggacggtatgacagtgattgcctatgacgggtttaaagaacaggtatggccgctgcccgtaaagactttgctctatgtgggccgggccaccacaggcaagctcaaatcctatgggatcaccaccatcggggcgctggcccaggccccgattacttttctggagcaccggttcggcaaaatcggccggatgctctggatgttcgcaaatggactggatacctcgccggtgagcaacatcggagcaaaatcactgatcaagagcatcggcaactccactacagccccacgggatctgataactgaccaggagatcaagatcactctgtatgccctctgtgagagcatatcggcccggctgcgggagcattcctttcgctgtaagacggtggcgctcaccatccgggacagcagtttaaccagctttgagcgccagcttgccttaaagcggccaagctgtatcactcaggagctgtttgacgcagcctttagcctctataagcagcatcataaatgtggattgcctgtacgcagcttgggagtgcgggcggcgaatctgatgcttatcgactgtatgcagctctccattttccctgatgtggcgagggcgcagaagcaggagcggcttgaggagacggtagatgatatccggcggcgttttgggcactttgcagtacagcgcggggtaatgcttaccgacccggtccttgccatcaatcccaaggaggatcatatcatccatccaatcgggttccttaactaaaaaggacgcctttgcccatactaacaatgggcggaggtgtttttttgatacggaaggtctatgtagaggtgacagcgcactttgatttggaaggaagcatgacgccgctggagattttctgggaggatggccggcggtttgaaattgatcgggtgctggaccggcggcgcgctgccagtctgaaggccggcggggtggggattcggtacctctgccggatacgtgggagggaaacttacctgttttatgagggacctcgttggtttgtggaggggaaatagccatcccatccaaaaacggcgcaaaggccgctgcttctcaaacgcctgatctctgcgcagtggtcattggcagcacagcggtacaggttttaatagcctgcaaggttatgttgcccaaactgcgtggacaaaagtggtgtgttaagccgggagcaatggaacatgaggtgttccttgcaatttttcttgtatatcttattatcctgtagtataataaacgcgttagttagcaaaaactaactgattcgtaataatacgattattgaagggcctgacacaaatactttgtgtggagaaaggaatatgacattacaacaactcagatattattgtatggcatgcgaatgccgcaatatcaccaaggcggcgaaaagatcttttgtgacccagccagcggtgactgcagctatccgagaattagaaaaggaatacgaagtgcgcctgatggacaaggatggcaagcacatcaggctcaccaaggccggcgaaagcttttataaatatgcatcccagatgttagatcatgcaaaaaagttcgatagccaagtgcaggacttagccaaccattccaaaagcctgcggattgggcttacgaagtcggcaggatcttcggtttatatggaatactttttaaatgaggcggaattttatcgggatttggagcttaagctgacggtggattctacattgaagcttctggaagaactccgggagaaggagctggatatcgcgctgatcataaaccatggcagcgaccctatggatgatctggggtgggtagagcttaaaaagacggggatgctttactgtgtctcaaaaatccatccattagcgcaggtggaacaattcacggtgtccatgattgcaggggagaaaatggtttccacacagcatgaccagcacaagtcggaggccttaaaaaaattgtttttgcagcatggctgtgaggacggtccccaagtggtctggcggttcgaccaattaagcacggcgcttaagatggtggcggcaaatctggcgaccggttatttcccggcggacggaatctgccagtacgaagggatcgtaggacggcctgtggagggggacgctcccattccgatctgcgccgtctgggggagggatggctggaggcgcgaggaggtccaacggtttgtaaatgggatagcaaggttttatagggcggcccggtagcgggccgccctttatagtatttttatctgtgctcctgcatttcgatcgtatggataattttatccagtctcgttttgaacctatctattatttttatttatcgattaaaaatttgtttgattttacaaaatcacaaaaatacggtatagttagcttgagctaacccacaaggaaaatcggaggagtggagcatgaatcgaggaattatagagcacaagaaggggatatctgtggcggctatgacagcctttctggtgattttgtttttcactctgatctgcgtgggacgctaccccataagtcctctgcgggctttcgagattatgggaaaatccctgctcggcaatacagaggggcttgacgcttacgaatcaagtgtcattctaagcatccggcttccccggatcctcatgggactcctggtaggagcggggctttctgtttctggcgtcgtctaccaagcggtttttggaaatccgcttgtaagtcccgatattcttggcgtctcatcaggagccggttttggcgcagcattggcgattctgttttcggcaggtatggcggcaacacagggtatcgctcttttattcggacttctgtctgttacaacggtcttaaatctgtcccgaattaagagacgcagcgagctgttcgttttggtgttatcaggggtcatcgtaaaatccatgtttgacgccatggtttctttcatcaagtacgtagcggatccggaggacaagctgcctgcaattaccatgtggctcatgggaagcctggcaaatgtttcctaccgggacgttgtcctctgcgctgcgatcgtgctgccctgtctgattattgccatggcgctgcggtggaagatgaatcttttatctttggatcaagacgaggccagatctttaggcatcaacgtaaagaagctgcggctggctgccattctgctctcaactttgatgacagcagtcactgtatcggtctgtgggattatcggctggattggactggtgatcccccacattgccagactcctcattggaaatgatcatcgaagcctgattccaaccagtgcgcttatgggttctatttatctgttgctgattgacacagcggcccgagcggccacggctggcgaggtgcctctatccatattaactgcgatggccggcgcgcctttcttcgcagtgattctcagaaaaacatcgggaggccgagcatgatactggaagtaaaaaacggctgtttttcttatgggcacagggaagtattgaaaaacgtctccttcgatctggaagaacggaaaatcatgacggtcttagggcccaacggggtaggaaagaccacgcttttaaagtgcattatgggttttctccgatgggacagcggggaaaccgtgattgccaaaaggaacctaaaggagtattccgataaggagctttggagggagattagctacgtacctcaggcaaaacagggcgtgttctcctatggcgtcttggagatggtcgtcatggggcttgacaaggaaaacagcttcttttatacaccgaaaaaggatcagtttgatcgtgccaacgacatgttaaaggagcttggagtcggtaagcttgcggattggtattgcaacgagctttcaggcggtgagttgcagatggtaatgttggcgcgagccatggtttcaaggccgaagcttttgattttagatgagccggagtccaacctggatatgaaaaatcaattgcgggttttggatgccattgagtacaccaacaaggagaagaacaccgcttgcgttatcaacacccactttcccagccatgcgttgcggctttcggataagacgctgcttttggggccgggccataagcaaaaattcggagctacggcggaaataatctctgaggaaaatatcgaggaattttttcaaacacgggcaaagattgtaagctttaccgctgataaaaagaaataccagatgatcgcgccctatcggattgccggcaaaatatagagaaattaaggaggaggcgttatgaaatacgcagttttaggccgttcaggaatgaaggtatctcgaatatctatgggtacccaccatctgaacaatccatcggatgtggacaagcacgtaagaaattttttatatgcttatgaaaagggaatcaacttttttgaaacctccgtcacctatggagacgggtattcggaactgatcctgggggaggctgttaaggagatgaaaaggggaaagcaaccttttttcatcatgtcgaaaactcacgcaggagatcatgagacatttcgaagggatctggaaaattccttaaaacggctggggttggaacaaatcgccgcttttacttgcctttggggcgtgaaaagcggcatggagtggaatggcgcgaaatcctacggggccataagggagatggagaaggccagggaggaaggccttatcagatacatcgccatctccacccatatgaaaaaccaggagcttaaacaggtcatggatgattacccctttgacttcaatgtccaaggctttaacgttgtcaacagcgcctgccgaatggatggggtgaaatccacttgggaaagcggctcggggtgcatcgccatgaatcccttggcgacaggagatatactgaaatatccgcatatcttcaacgctatccgcatccgcgaggctcagagcctagtccaggccgcttacgcttacgtgctttcggtgccatgggtccattctgtgcttgggacctttaattgcgaggcccagatcgacgaggctctggctgctctggatgagacgccctactgcagcgaggagctgcaagaggtcggactccgtttgaaaaagagaatcgagagctgttccttaaaggagcggatcgaagctggaaagctcctgcgccagaggccctatattttaagagaggaggtggcggctctgatgggggtttatcccttgagcgtttaggggtaggcatacagacgcttgacagggtgttttcaagcttggtaattatgatgtcatatatggaggaataagaacatgagaaaaatactcagcctgattttggcagccgttttttccctgaccgcctgttctgaggcggggggaagccaagggtctgctgtggtgcaagagccggcggcaacagcgagcagctctggcgaggcaattgaaagctatacagtcactgatgtgagaggcaaggagattgctttcgacgcagttcctgagcgggtcgctaccgtcggaaaacctttcccctccctttactacgctatcgaaggggcgacagaccacattgtcggatgcaatccgtcttcaattaaggcgtacaatgaaagcgtattgaggtacatgtatccgcaattggaaaacgcggttacggattggtgcaacacggattccaccgtcaacatcgaggagcttttaaagctgcgtcccgatgtggtgttcatctattccaccgatgaccaggaaattgagaagatagaagatgccgggattaaggttgtggcccttcggagtgcagagttagacagtgtaaaggaaaatttgcagatcatagcggcagtttgtcaaaaggaggagagaggtaaacaactgatacagtacatcgaggagcagattgtcgaggtgacatcccgcctgactgatgtggctgaggaggataagccgtcggttatcgaattttatagcgatatgaatgtatccgtcagccagtacgaccattggatgattcccagtggagcaaaaaatccggctgaagggttgaccggcaagatgtcagaggtagatatggagcaaattcttgtgtggaatccagatattatatatatcggaaaccattctgatctgatgccttcggatcttttggaaaacaagcaggagggcagagattggtctattgtcaacgctgtaaagaacaatcaggtttacaaaattccaatcggtgcttatcgttgggatccagccggcgcagaaacaccccttatggtcaagtgggctgcaaagctccaatacccggagatttttgaggatatggatatgaggcaagaggtaaaagatttcttcgattacgtttatcagtatcaattaacagacgaacaggtttcggagattttggacaacagacaacaatgatgaggaacggaagcttttaaaggccgcgtggaagattttaaaaaacaggaggtgcgttggctgccgggactgcaagcatataagcactgggactgcggcctttagggcataaagagggcggcggcccagatctgaaaggagaaataatctaatgaaaacgatcacagtactggagaatgggaaaaaatttgaattcagctttgaggacatgctgaagtatcacggagtcggctatccgggcggtgtggcccatgcttttcaggtgatgcaaagggccttcccgcttttagacgacggaaagcttttagaacgccgaaagattgagcttgtgactgcattccccggcccaggcggacgggatgccttcgagcttgtaacccgttgcgtcaccgatggacgaattcatgtggacaaggatatgcctgaggcagcgggaatccttgaaagtccacatggaagatattatttccgctttacatacaaagagaggcatgtaatcgttactatccgccccggtttcgtacatcaggatttcatcaatatggcgagaagggagaaccgaactgagcaggaagaaaaaatcttggcgcaaatgaagcaggatatggcgaaacggcttttggacgcgaatccggaagatatctatgacgcggtgattgcggagtaagaggagcacaatgctgcacgctatgtaaacatagaccaccgcgcggttaagccatttgccgggtggctggtcaaacatctgaaatctataagcccccggtttgtaagatcccagcagtctcctttttcgtcaaagtattttatataaaaaggctgttatacagattttactgtataacagcctttttttcttttttttaattttaagtgaagtataaaaccattacttcctgttaggttttctttttatccccagcagtttgataaaatcatcaaataaggcgctatctgttggctcaaacattaaccattttccgtcgtgataggttttagtttcatcatagactttttgcatttcttttgaataactatttctatctgtatcaaattttaattgttcatctttccctaagataatcataaatcctatacagttttcccttgcatataatgcacaaagcgtttttccgccacgacgatatttatactcataagtccacgctttaccacctttgttccataaacattccatgtcatacttttcatcaattaaagcacaaagtttattccatatatcatataacgattgtccgattaaagcagtcatttcttctgcattgggtattttatccaacatgctcgtttctcctttataacttcaaatttgtcgttctttcactttctcccccgctgtggatttggatttttcagcaagtccgacttctccgcaatctttttcagccacttcttttcgtcctctgacagcttcttcaaattcaatttgagccgcttacagataaacgccaaagacgcttgctccgggtcgctgtcctcgctggcggctttgtctgcggcctgtaaaaatcctttcagtggattatcctccggaacgctgaaaaaatcgtctttgtgggcttcccgcaggtcaagggctattttgtttatgtcctgctgtatcacatagcggcaaaagctgtcctcgtcaatatgggcggtaataagctgtcttaactgcgggtcggtcaagccagggttgtgctgtttcataatggttgcgctcacagcgtctacaatagcgtttgcgccctgcacttgctttgtcgctatgccgttcacatagatttcaaggtcggccataagccggggaaaatccgggtgtgttgctaactcacacaatagtgaattatccaccgtccgcttttcaacagttcaatcatatcatcactcaaacgcagttctgtaagatcggcgtttgggtgattttttgtttctgacagccccagcaggtaatcagcggtcacgctgtaaaacttcgccaacttgataagggcatagtgactgatgtccttgaagtcgttcacttcataacttcctagtgcagatttggaaagatgggtctgttccgcaagctgttccagcgtcaaaccacgctccacacgcaagtcttttagacgttcctgtatggatagttccatgctccccctccttggctactcaatagactgggttttacagtttcttagtaaaacagataattctatttgcttctgtaaaattcatagccttatgaaaatgaaagctgtctatattgtctatttcacaatcactggcaaattcatgacaaccattttctcttgcccacgcttcacatgcggctaacaattttttagcataccctttattacgatagccctcctttacaaaaattccctctaaatatccgactggagatgtacttgtaccttccacataatcatatcttaattggcactgtgcaaaaccaataggcacgttgttctcgtattgcaaaaagaattgtgattttccattagtcataatttccgaaaattcattgattagttcattgatagaatgctctcgccacatcagcacagctaattttgccagtatttctaaatcctcatttcttgctttttttatcataatgcagcccctttgaaatcatttttcgtttttcttccattctaccacaattccaagagcgtggaaatgggctgtttttcaggctgatttcctacatttcggatatacggcacaggcggttaaaaaggtctacacttaaatcagttcattgatggacagcaccttgaaaacagaatgaccgtccgaaaaggaatatccggcgggggaagcacgcagggagccgacttctggacactttgtccagagatggcttcgggacaagttgtcccgaagttatggggagcgtgccaacgccggaacacgccgcaggaatgggggaggaagccttttcggcgagaacggcaaaagcgaaaaaacggagggactacatgaaaagcaacccatataaaaatttatcacctttggagcgcaagcaggacggcacgccctaccgcatgaccccggtgcagaggaaacaggcgaacagcctgatacgcagggcgtgctgtaactgtgagggcggtaactgtatcgcccttgacgatagcgacacctgcgcttgccaccagttgatttctacacagtctgctgtaaatggttccgttgggcggtgcttccgctggacaaggcgctggaagcggagatctactgcggggacaaggtgaaacggtgcgccgtctgcggtgcggctttcgtcccacgctccaaccgggcgaaatactgtgaagcctgcgccagacaggtacgcagacagcagaagaacgccagcgataggaaacgccgcttgaatacgggcaaataggggctaaaacaacccccgaactgtccgcaggaagaaggattgacagccaatggcacaacacgcaattttgcgttttgagaagcacaagggcaacccggcaaggccgttggaagcccatcacgaacggcaaaaggaaccgtacgccagcaatcccgacattgacaccagccagagcaagtacaacttccacattgtcaagccggaaggacgatattaccacttcattcagaactgtattgagcaggcggggtgccgtacccgtaaggacagcacccggtttgtcgatacgctgataaccgccagcccggagtttttcaagggaaaatccccaaaggagatacaggcgtttttccagcgggcggctgacttcctcatcggacgggtaggccgggagaatattgtgtcagcggtggtacatatggacgaggccatagccccctatccaaattcccgcccgcaggcggaatcaatgagggtaaaacgccccatctgcatttgacctttgttccgctgacaaaggacaaccgcctgtgtgctaaggagattatcggcaaccgggagaatttgacgaagtgacaggacgattttcacgcctgcatggcagagaaatacccggatttggaacgtggggaaagcgccagcaagacagggcgtaagcaatatccccacccgacttttcaaacaggcggccagcctctccaaacaggcgagggcgattgaagccatgctggacggtatcaacccgctgaacgctgggaagaagaaagagtaagccctcattatgctgaaaaagcggcacacaagagagaggcaaacgctatgaacaggatttattatcacaaggtagattatttcaaccgggagggcactggatggcaaaaagcgaaagcaatatttttacgccataagggtatagctgctcaggaaggttcagaccgccattgcgcagatagaaggctcccaacgcatgataactgcttacagggctgcgacggcagcaaggagggcgtgaatgcggctgcggagatatctttcaacggcataaatattacatcgtcaatgggtagaaatacagaatatcagtttatctcaacagatacggccgaaattgtatccctgctgacaacagcctatgaaaagatcactggcatcacagtccatcccgccagcccggaacatctgttcatccgatggatgggcaacataatcatacaagaacgtgttttaaataattatacctgcaatcaaaacatcccaagccgtgccgaaggcaggaacttggatgcattgggcgaactgtttttagagcagacccgccctggagccaagcccgcccgatgcaccatccgatttgaaatttcagaggcgcagctatttgccgttttggtgcctgcgggaacaagggttacggatacaggaggcgtcctgatctggcaaacggaagcggatatctatgtgccggccggtgaaacctctgtggacgcggaagtggtatgccagacctccggtacagtgggaaacggctatgtacccggacagattgataccatcatggacttgtacgattactgtacaaagtgcgtcaataacactgcatccgacacaggcgcggacatggcgacggatgaagaatattatgagcttatgcgggccagtatggacggatatagctgcgccggcgctggcgctgccggtactcgcatacttcggcctggcctgggaggatatgacctcctggggcgcgctgcgggatgtgtttctgcgcgcggtgcagaatcccgttgtgctgcttgctgcaagcgcagcgtccggcggtgagcggcccgcgcacgggccgcgcgcgccaaagccggccgggcaagcgcagcgtccggcggtgagcggcccgcgcacgggccgcgcgcgccaaagcgcctgcttgacgccttttaagcgcgtggaccttttagaaaagccgcagcagaagcatatagacggccgtggaaacgccgatagaaagcagattgttgcgtttccagacatggatcccaattgtcaaactgacagcgatgatctccggcacgccgaaggggacggatgtaaaatcgacgccgcgcaggcagtagaccaccaggatcgcgatgatcgcatacggcagcacgcgtccaagatagatcaccccgccggaaacaggacggccgtctctgaacagcaaaaacggaagcgcacggcacagcacggtgacaccggcgaccgtaagaaccacagcaagcgcttgaagcggtgtcagcggcataccgcatcgcctccctcctgcgaaccattcaggcgtttttccaacggccggcggccggccaaaagagcgccgacggtcaaaagcagcgccggcggcagaaaaccgtccgttccaaacagggcaaggcagaccagcgcgcatccaagccccgtcagggcgggaatatgcgtttttgaattaagccactgttcgacaaaaatgacgataaacaacgcggtcattgcaaaatcgatgcctgtggaatcgaagggaatcagctcgccgaccgtcgcgccgatcacactcccggctatccaatagcactggttgagcagggcgatcaacagatagaaccggcctcgcggcatcgcttcaggcggcttgatcgagcaaagaagggaataggtttcatcggtgagcgcaaaaataagatagagctttttgatccccagacccttaaacgcatcgatcagggacaggccataaaacgcatgacggatttggaccgcaagcgtcacgacggccacatgcaaaaagcccggccagcccatgagcagttcgaccaagacaaactgcatcgaaccggaatagacggtcaggctcgacaaaaaggcccacagcacgccgtagcctgtcttttgcagcagcaggccaaacgccatgccgacaaacacatatccgaaaagaatcggcgcggtcgcggccgcggccgcccgcagccctctggtaaagctgtttgacatcgccctgaaagcgcctcccgccaagaccgcgcagcggcctgaaatgatacgcgcaccgtggaaaacaatgtcattttagcatacgaaacagaaaaaaacaacggattccgaaaatttattgctttaaatcgatttgaaaaaacggttccggcatcctgcaaaacgacagggcctcatgcggtggaagacgacgccccgtcttccaccgccgcgtcgagcacctgtttaatgacattttccatcatctgttttgtcatcgcccccggcgcgtagccaaagatattgccctgcgcgtcgattaaaaaggtggtcgggaaggcgctgataaaataatcggaaaacacgccgcccgtcgtgtcatacacgcttgggaacgtatagccgttgtcggttaaaaactgtgcgatttcctcaggcgagccatcctgcccatatggattttcatccgtctttggatttgtcacacctaaaaatacaacgtcgccggtgttttgcccgtattcattgtaaagctcctcgatgtggggcatctcctgccggcatggcgggcaccaggtcgcccagaagttgagaaacacaactttgcccttgtaatcggacagggtgtgcgtgttgccgtactggtcggtcagcgtaaagtcaaaagccgggatgacatcggcctgctcgggcgcggaggaggaaggcgccggggatgaggaggccggcgcctgtgcgccgggatcctcggacgcggccgcctgctccggcgcggcctgcgaggacgagacagaggccgctcccccatctgaaacggacggcgcgccgaacgagcttaaatagccggtgacgccgttcatccaaccggtgaacgtcatgacgccgatcaggatgagcagcgcgccgcccgtcttgattgtatagcgcatcagctttttgtggctgcgcagaaaattgagcgcctgcgttgtaaacagcccaagcgctaaaaacggcaggacaaagccggccgcatagagcaaaacaagcagattgccggtggcggcgcttttcgcgccggaggcgagaatcagcacagaggaaagcgccgggccgacgcacggcgtccaggcaaaggaaaatgtaaagcccatcacaaacgccacaaccggattcatccgcttacccttcatattcagatggaagcgccgctcccgctgcaaaaacggcagctcgaaaaagcctatctgcacaaggccaagcaaaatgatcacaacgccgccgatgcgcgcaaacaatgttttatgcccggaaaaaaacgtcccgatcgctgtaaacgaaagcccgagcaggaaaaacgcgaacgatacgccgaggataaaaaatacggtatgcagcatcacgcggccgcggtgatagaccggcgcgcccgcttcatcgcggtcggcgctgcccgccagatagctgacataaatcggaatcagcgggatgacgcacggcgaaaaaaaggacagcagtccttcaatgaaaaccagggcgaagctgatgtgctcgcctgtcagtaagctctgcatatggttcctcctgtggattattaggtaatattatacaggaacggtgtagaaaagggaagggcgattttgcatctgtggaagatttatgctattatatacaaaactgacggcggctgacggtgacgccggtcacggaaagcggggaatcatatgaaaaaggttcgcatcactgttctcaagacgacattcgacgaggagcttgcgcgtgagtacggcgccgaaggcttgtccgcctgcccaatgctgcgggagggccaggtcttttacgccgactacgccaagccggccggcttctgtgatgaagcctggaaggctgtttaccagtatgtgtttgcgcttgcgcacggggccggcgaacatcttttttattacggcgactggatcagaaaaccgggcgttgcgatctgcagctgcaacgacggcctgcgtcccgtcatctttaagctggaatcgaccggcgagacttcgcagatcgactatacgccggtgagatgaaccggccggggggccggacggcgggtacgccggatgcggcaggcacgctgcggcatgtgcaaaaaagcgcgtgtccccgggcggccaaacggtttgcgcgagcctgagagcgggaggacggctgaaacggatgaatgacaatgattttatgggcgaggcgctccggcttgccgggtgcgcggcggagcgcggagaggtgccggtcggagcggtcgtcgtgtgcgacggacagatcgttgggatgggctttaaccggcgtgaaaccgggaaaaatgcgctcgcgcacgccgaacttgaggcgattgacgcagcctgccgccggctgggcggctggcggctgcaccggtgcgagctgtatgtgacgctcgagccttgcccgatgtgcgccggtgcgattatcaacgcgcgcatccggcggctggtgttcggcgcgcgtgatcccaaaagcggctgcttcggctcggtaagcgacttcaacgcgctcgccttcaatcataagccgcaggtcgtctgcggtgtgcgcggtgaggagtgcgcgcagattctctcagcgtttttccaaaagttgcggcgcggccgccaatagggcacaagatgttgtgtctgttcacaatttgttcaccattttccggcacacgcatgatataataagcaatggaaacgcagtgtttctaaagtgaaatcccccctcctttattttatctccggatcatttcatttgcagcgggccgtgcggctcgtttttttttgcagttcgcgccggcgccaggcggtttatcatttttttaaaactccaattttaaacagcgcccaaataatctatacatcgcgtgtaaaatatgagataatagaagccgcaggcggcatcgtctgcggcaaaatcacttgaacattgatggaagccccggacggcggcttcaggaagggaacgacatggacagctattttgtcgagattcagcggccgtttatgccgccctcggacgacgcgcgcctggtgttgattgcggacggctcgctgcaccgcgcgcttgaggatgtcaaacggcatctgttttcctgtgtgaaatacgccaaaaagcacggcgtttatgtattgacgggcctgttcgcgcacgagggcaacctctgcctgtgcctgctcgatccgggcggcgaggtggtctgccgccagccggccatccatccgtccatttcgtttcagggggagtttctgcccggcgaccgcatcgaagtggcgcacgcgggcgagcttggaaatgtgtgcctgtgcgtggactgcgacatcaatgatccgcgcgtgctgcgtgcagccgctctcaagggcgcggacgtcgcactgtcggtccaggcgctcgacccggtgcaggatgcgggcgaacgcctgctgcgcacagtgtggagcggcgcgcagggcaacaacctgtatgtggtcaacattgcggcgggcagcgccgcggttgcatgtccggcgggcgtgacacgcgcgggcgacgggtatctgatccgccagacctcctctttcccggtgcgttttgggctgaatatggcgcgtctcgatgaaatccggcgaggtctgcggcttttggaacagatcaatcccgcgctgatcgcaaactatgaagccgagcttgggaggtaaaaggcatgtgggaagtgctgctgccgctgatttctttttggatgtcgtttcgggtgacgccgaaaaaaatcgacgcgctgctttcggaaaaaagcggtgccgcccaaaacaacgcggaattcgcggcgccggaggcggtgcgcgccgcggccgtccaattgacggcgcgcgcatataaggatctgcgcgactatatggacgaagtgtatctgcttgccaaaaacgcggtcgacgccggcgcgcaggtggtcgtgtatccggaatatgcgggcgtgctcgccctgaccatgctgccgctgagcaagcagatcctcaactgggtgctgcgcgggagacatttcattggtttggacggcgccgcgcccgatccggtgcgcatggaaaccgtgcttgataccttcggcggctttttaaacgagctgtatcagaccgccttcagcgggatcgcccgcacgcttcgcgtttatgtggtcgccggcacgacgctcgtccgcgaggaggacggccgcctggtcaaccgatgcatcgtgttcggcccggacggcgaacaggccggcgtccaggataagacaagcgcgctcgggttcgacaacgacgccggcgtttcgccctccgatgtcctcgagccgatcgacacgccgctcggcccgctcggcgttgtcatcgggtcggacgcttattactttgaacgcttcaaaatcctcgcggagaaaggcgcgcgcctgatcgccgtgcccgacgctcgcggcgggatcatgcccgacctgctgcgctgccgcgcgaatgaagcgggcgtttatgcgctgtacgcctgctatgccgccgggccggacgaaggtccgaatgtgcgcgccgcgatctatgcgccgttcggcgcgacgcccacgctcaacggcgtcgtcgcctatgcgtcaaacgcgcatatctgcgctgtaacggcgcgcaccaatctgcaaaagctggccggcgacctcaccgatccagcccagacaagccgaaacgaggcgttcaccaaaggcgattacctgcacagctaccgctactgcggcaatctcccctcaaaccttccttaaaaaataaaatcgctgggctggccggcgtcaaagaggatgcggggcgcgcagggaaatctcatgttaaatattcacaaaaaaccaacggcttttttggcgtagaacaccgctgaaagggccgtttgtcattgtatccgcctgttttttgtgttaaaatgaagctgtatcgttttataatcaggaaaacgcttgtggaattttccagtataccgccgctcttttaatctgcaaaaacaagcgcgggcctttggcggataagctgttttccattgacaatatctgatggaaaggcgtgatcaatcagcatggcaaaacgggtttttttaattgttcttgacagcgtcggcatcggcgaggagccggacgccgctgattacggcgacgttggcagcaatacgctgcgcacctgctggcgctccggaaagctgcatgtgcccaacctgcaaaagctggggctttttaacatcgaaggcgttggctgcggcgaggcggtcagcgcgccgattggttcattcgcacgtatgcaggaatcgtcggccggcaaggatacgaccatcggccactgggagattgcggggctgatctcaaaaaagccgatgccgacctatcccgacggtttcccgccggagattatctcggagtttgagcgccgcacggggcgccgggcgctttgcaacaagccctattccggcaccgacgtcatccgcgactacggccgcgagcatgtaaaaacaggcgcgctgatcgtctatacaagcgccgacagcgtattccaggtggcggcgcatgagagcgtcgttccgatcgaggagctttataaggactgtgaaatcgcccgcgaaatcctgcacggagaacacggcgtcggccgcgtgatcgcgcggccgtttgaaggcgaatacccctacaagcgcacctcgaaccgccacgatttttcgctccagccgccgcgcgacacggttgtcgacaagctttcgcaggccggtctggacaccatcggcgtcggcaaaatttatgatatcttcgccggccgcggcatctccaggacaagccgcactgtcaacaatgacgacgggatggaccagacaatcgcgcatgcgcgctccgattttcatgggctttgctttgtcaaccttgtcgatttcgacatggtatacggccaccgcaacgacatcccgggctatacggccgcgctcaaccgctttgacgagcgtctcggcgaattgatgccgctgctcggtccggacgatgtgctgatgatcacagccgaccacggctgcgatccgggtacggcgtcgaccgaccattcgcgcgaatatgtgccgctgctcatttacggcgcgtccatacgcgcaggcgtcgacctgggcacgcggccgacctttgccgatacgggcgaaacagccgccgcgctgctcggcgtcaaggctggctgcgacggcgtgtcgctctgcggccagattctgcggtaactacagatgaaatagggagggcttgcaattatgcgcatgtacgatatcattatgaataaacgaaacggcggcgtgctgtcagacgaggaaattgcattcttcatcgacggctatacgaacggccatatcccggactatcaggcgtcggcgcttttgatggcaatttggtttaacggcatgaacgagcatgaaaccgcggtattgacagactgcatggcgcgctccggcgatatggtcgacctgtcggccatccccggaatcaaagtggataagcacagcaccggcggcgtcggcgacaagacgacgctcgtcatcgcgccgattgtcgcggcgtgcggcgtgccggtcgcaaagatgagcggccgcgggctgggccacacgggcggcaccatcgacaagcttgagtcgatcccgggctttcgcgtatccgtcgaacgcgagcagtttttccagattgtgcgggacgccggcctgtccgtcatcggtcagacaggcaacatcgcccccgccgacaaaaagctgtatgcgctgcgcgacgtgaccgccacggttgacagcctgccgctgatcgcctcgtcgatcatgagcaaaaaactcgccgccggctcgaacgcgattgtgcttgacgtcaagacgggcagcggcgcgtttatgaaaacgctcgacgattcgatcgggctggcgcaggcaatggtttccatcggcgagcgcaacggacggcgaaccatcgcgctgatcaccgatatggacctgccgctcggacacgcgatcggcaattccctcgaggtggccgaatcggtcgcgacgctgaaggggcatgggcctgccgatctgaccgaggtctgccttcagctcgcggcgaacatgctttacctggcggacaagggcacgctcgacgaatgccgcaggctcgccgaggacgcgctttcgagcggcgcggcccttgaaaagctgcgcgcaatggtcattgcgcagggcggcgacgtttccgtgatcgacgacacttccaaattcccgcaggccccggtcacatatgaagtcaagtcgccctcagacggctatatcacgcacatggagacggaaaagtgcggcattgcgtccgtcgcgctcggtgcgggccgtgagagcaaggaggacgatatcgacatgagcgcgggcgttgtgcttgtgaagaaaacgggcgacaaggtcgcgcgcggcgagacgatcgcacgcctttacacggcaaagcagtctgcgatccccgaggctgaacgcctcctgctcgacgccatcaccttctccgacaagcagcccgcccctgaaaagctcatactcgcgcgcgtctccaaggattccgtcgaacgcttctgaccccggcctttttgaaaaaaggcctcggcgaaaaacttcattcggctgcgcccccgcttttttgaaaaaaagctcggcaaaaaactttagccggctgcgccgcgaatagtgggtttggcgccgcgttaatataggctgcgcccgccccagggttgggtccatgggataggggcggcccgcccctgtcccgtgaggcgcgctgaggggcgttgccgcggcttgtccgcgcccggcgctgtagcgccggaaagccccgaatagccggtcgggcaagcgaagcgcccggccgtgagcgacctgcgcacaggtcgcgcgcgcctgagcgcccggccgtgagcgacccgcgcacgggtcgcgcgcgccagcgcggcccgcaggccgcaagacacctgttcagaagcgggacctttcgccagcaggagaagtgacagacgccgcgcggctggcgcgcatcctgcaagttccaactgtttagaaagccccagtaaaaaaccttccgccttttctttaaaaaggcggaaggtttttcgatacatttatttcccaaaaaggcggagggtcagatacgctccaagttttgctcgcgggacggaccgacgccgaccatcgtaatcgggcattcacacaggcgctccagctctgcgatatacttcttgcaggcctcgggcagctcgtcgaaactgcggcagccggacaggtcgccgtcaaacccctcaagctcctcatagaccggggaacactcggcaagctcctcgatggcggcggggaaatcgcgcaggatcgtcccgtctgatttgcggtaagccgtacacaccttgagcggacccattccagaaagcgtatcgatcttgttgatcgccagcgcggtgaggccgttgatacgcacggaatggcgcatgattaccgcgtcgaaccagccgcagcggcgcggacggcctgtaactgtgccgaactcatggccacggttgcgaatttcatccccggtttcgtcgagcagctccgttgggaagggaccggcgccgacgcgcgtcgtatacgctttggccgcgccgacaacctcgtcgatcagcgtgggaccgacgccgctgccaacgcatacgccgcccgaaacagggtgtgaacttgtaacaaacggataagttccgtaatcgatatcgagcagcgtgccctgcgcgccttcgaacaggacctccttattctcacggatggcgcggtatgcgagtacggaaacatccgcggcatactgcgccagacgtttcccatagactgtgtattctgcaatgaccgcgtcgagatcaagcggctggccgccataatagccggtaatcaggcggtttttcaattcgccggcggcccgcgccttttgcgcgaacaaatccggatggatcaggtcataaatgcgcagtccggagcgttcagccttatccatataacagggaccaattcctttttttgtcgtgccgatctcgcccttgccgcgcattttctcgctcagaccgtcgatctccagatgccacggcatgataacatgcgcgcgcggatcgatacgcaggtttttacaggaaactccccgcgcttcaaggccgtcgatctctcccaggatacctttggggttgatgacaacgccgctgccaagcaggcagagcgtgtccggatagaggatgccggacgggatcagctggagcttgtagacctcgcccccgttttcgaccgtatggccggcattgttgccgccctgcgaccgcacgactacgtcggcgcgcgacgcgaggatgtcgatgattttgcctttgccctcgtcgccccactggacgccgacaaccactctagctggcatatatagcccccccaatgaatttttacaaaaaaatccagtccctttgaaccgttgttaagtatagcaaatttgcagacaaaatgcaatgttgatttttgtaatttacttttatccaaaagtcaagcgtctgcgcgaaaaaagaaatcctcacgccttacccgccgtgatcctccttgatctcgcccgttttataggccagaagcagccacttgaggtcctcgatattgcggctgagctgcgcgccgatatctgtctccccaattttgatacgcgactgcatccgttcaaatacgactgatgtggatacaatatcccggttattgcgtattgcgtcaagccgaccgtcaaacggctcatgcgatgccagccgaatgccccaggaattataaatcagcgtgtagccggcaatacctgttgtcggctggtaagcccggcagaaaccgccgtcaatcacaatgagccggcccccggccttaaccggattttcgccctcctttgtcttaacaggcacatggccgtttataatgtggcagtgcggcccttccaatccgaattcacgcaaaatgcgcacgcagacgtccgcgtcgttatagtaagcataataagcgttttttggctcggcccatgcggcatgatcggcgatcaggcagcgttcaaaggtcgcaatatggtcgcgtccaaacagcggggagttgcgtccgcaccagagaaaccataaaaagtccttgccgaattgtttttccggcgtgccttcccgcgcataatagccctgacgcgccagcagatcagcacggtcgagaaacgcccggccgctgacaggcgcgccgccgatggaaaacgacataaacgatccatccgcttccattggtatacatccgtggaacagcaggtttccattgtagcacttgtacagcccgcccttggaatagaggaagcgcgcgtgcttttgcagcttctcactgtgtaaaaatgcgtcgcgaagctgctccattaaccgctcctcctccttggacagcatatacggagcagccgggtcaaccgttggaaagtctgtgtgcacaagctgatattcgctgccatcgatttggatggtcccgcgcttataatcgatcctatcgagcagcaggcggtcgtccatcccgaattccggattgcgcctgataatctgcccttccagtttaaagaggatgattgcaatcgctttgtgcatccgcgcgccaagctcgatgtccttggcattgtaggcgatggcgtcgcccaatgttttcgtctgaaagcacgaggtgtcggagtcccgataaacctcattggcaaacagcgcaagcggacgcaggctgatgccgtagcctgtttcaatgacttcaagattattataggtgatcgaattgttcagcacggccgcgatgcaggtgcggctgcccgtcgcggcgcccatccacagcacgtcatggtttccccactgaatatcgacggaatgatgctccatcagggaatcaagaatgatatcggcgcgcggcccgcggtcaaaaatatcgccgacaatatgcagatggtcgacaacaagcgttttgatcacaccgcatacagcttcaataaaatcctcggcgcggtcgatgtggataatggtagaaatgatattttcatagtagtccttcttattatggacctcgtaattggtattgagcagctcgtcgataatatatgcgtattccggcggcagcgccttgcgcaccttggaacgcgtgtatttcgatgtgacgagccggcagatctcaatcaggcggtgcagcgtcagcttataccattcgttgagatcctccacgctctcgcgcatttcatccagcttctctctgggatagtagatcagggttgccagccgcgcgcggtcgtcgcgcgacatcacgttttcaaacagggcatccaccttttcgcgcaccgccccggaggcgctgttgaggatatgtaaaaacgcctcgtattcgccatgcaggtcagacatgaaatgctctgtgccctttggcaaatttaaaattgcctggagattgataatctcgctgcttgccgcctgcacggtggggtattgcctggccagcagccgcagatagcgcaaatccgcctcgcggttcgttgtggcttgtgcctgcatcgtgttccctccaatattttgatacggatgacagcgcattctatccgtctggaatacgccgccgccccggccataaagcggataataaccgctatgcggttatggagccatgccgctgcgcggccttggctgcattggccattggggcggcagcgggccgtgcccgcgtattgctccagccataaagcggataataaccgctatgcggttatggagccatgccgctgcgcggccttggctgcattggccattggggcggcagcgggccgtgcccgcgtattgctccagccataaagcggataataaccgctatgcggttatggagccatgccgctgcgcggccttggctgcattggccattggggcggcagcgggccgtgcccgcgtatcgccccggccataaaacggataataaccgctatgcggttattatcccagaaaacgcgtgcatttgcaatgtgtacgccgcacaaagacgcccggccgcgcaaaagcacgggccgagcgtccttgtcagatcgctatgatttttccggcaggccgatctttacaagacagccctttacagcgccggaggcgtctgtgtattccattgcgcacaccattgtgtcagggttatagccgatcaggtcgctgaacaccgtttgcaggactatgttgcccttgcggtcgatcatgcagatttttccatccttctggacaaatgcaacatttttgcctttgataaaggcgtctgcattgtcgtactgcgcgtcgatcagcagacggccgcggtcgtccgcatatccccacttgcccgatggagtgagcaccaggttatatttttcaccgtcctgccccggcacaataaaatggtcggacgggataatcacacgcccgtcgccctccacaatcgaactagaatacggaccgtcgccgccattgattagataataccccttgtccagattcgcgccgtcggttaaaacctcaccgtcgtaacgggccggaacaatttcgttgccgttgcggtcaatgacgccgtagcggccgcctttttcaaagcaggcatatccataatcgccaaaccctgaaacataatcatataccggatcaattgacatcttgccgctgtcgatatctgtaatcgcgccccaacggccattcttgctgacgcttacgctgccgtcataaagatacagctcctcccactcgggcttgatgacttccgcgcctttgtaattgatgacgccgtattttccgtttttcacaacaggcgcgtaatcgccggtaaacgatccgatgctttcatacacaggatcggtcagcattttgccgtctgtatcgcacaaggcccatacgccgttcatctgcaccgccagcaggtcgcgccctgaataatttggcgagccgctccaggagacgatctgcatatcctcaaccgcaaaattttgtaccggctggtattccttcgaataaatacgcagcattccatcttttaacaggatatgacgtttgccgagcacatagaagtcgtcgccgcgctcaaatgaatagtgtgaattgccgtcgcggtcgatgatttcgtattgatcccctttctgcacctgtatcagtccgccgccgtcgccacccgccgaccagacgtcgtcatattcaaacggcgcgagctgcgtgccgtccgacatatcaatcgcgccggttttgccgtcgagcgtcagcgggattaccccatgaaaggtattccacccctccagcgcggacgtataaagcggctctgtcagcagcttgccattggcgttggccactgcaagctttccattctgcccaaggaaaaagaactcgcacgtttgaaagccacggaatccgccgcggttgagcgggaaattcagatcatactgcgcgggcgtcagcgcctcggccgtgtagccgtccgcggctatttccacgattgattccggcagcgtgatcgctccggccgtcgcctgcggcggcgtatccggctgcggcgcgctggcaggcggctgcgaggactgagacgcgctggcaggcggcgcttcctgcggcgcctgctctgacgcgccgggcgcctgcgcatccggcgccgcgcccgcggcggacgaagcgcccggctgcaccggcgcgcttgccggggccgccggctggcagcctgccagcagcagggcggcggcgagcaaaatagcagcttgttttttcatggttatgcttcccttccggggcaaaccgcccctctgtatatacagtgtcccatttcctccaatttcttccccgctttccggcctttttgaaaaaaggcctcagcgaaaaactttaatcggctgcgctccggcctttttgaaaaaaggcctcggcgaaaaactttagtcggctgcgccgcgaacagcgggtttggcgctgcgtttatacaagctgcgccgcgaacagtggagcggacgctgcgtaatcaggttttatgcggcatgatctgtcaaaaatctttgagcgtttcgccgatgggcgcctgaatcagcagatccgcgcctgcgtcgagcggcgtgggcgacatattgattacgacaaggcggcctttgcagtagcgcacaagccccgcggccggataaacggccagggaagtgccgccgacgatcaaaagatccgcctgggagagcgcctcgaccgcacccatgagcaccgtctcgtcgagctgctcctcatagagcacaacgtcgggcttgatcgtgccgccacaggaacagaccggcacgcccggtgcgtccagaaccgcgtgtaaatcgtaaaattttccgcagcgcatacaatggttgcggtgaaccgagccgtgcagctccagcacatttttgctgcccgcggcttgatgcaggccgtcgatgttctgcgtgacgacagccgtcagctttccttccgactccagatgcgctagggctttatgcgccgcattcgggcgcgcgtcgggcgcgagcattttctcccggtaaaatgcaaagaactcctcagggcgctccatgaaaaaggtatggctgacaattgtttccggcggataacgccatttttgtctgtaaagtccatccgcgctgcgaaagtccggaatgccgctttctgttgacacacccgctcctccaaagaaaacaatccggcggctttcgccaatcatgcgcttgagggcttcgttttgttccatactgaaaactcctttcgctgtacatcaattccaccagcttttcagggtattcatccacataaaattggttcattttcacatatagggcttgtatttttggaaaattatgctatacttattgtagtatcggacaggtaacaatcgcgcttacttctctcttccacactcttatatagtgaaacaagcgggctgcgtcgcaacggcccgcttgtttccgttttattgactttttttccgatcagcgcgccgcgtgcggatctccgcctttacttccgcgccgacacggtttgagtcaagcagcttctgcgcggccatacgcagagtctgttcatccagccgcccgctttccagcagaacggctgtccgccgcggaaatttaataaaacagaccgacagcgcccaagccacgcccattttgacataatagccttcatgatgcactccggccaaccattccaaaacacggtcgatatacgcttcgtcgataaaatggtccatcagcatcacaacgccgaaacgcacgtcgaattcacgcggcgcagacagatacggcgtcaaaaaaccggctgcctgttcccggcatttgcccacggcgcgcagaccgccgcaggtaacgtcgcagacagcccaattgtcaatgtgcggcacaaacgccgccaaacgcgcaaacagctcgttctgctccatccttgcacagccgagcacaagtccctggagcatcgtctcctcataggtgtcgtggcgcgccgcctcaagataaccgcgccaatcgccgcgaaccagctcgcgcgcgagctggcgcagcgccgggacacgcacgccgagcaggtttgtcacatcaggcaccagtttttgctgaaacgcctgataggccggatccgccaacgatcggaggcgcgcctgcagggcctcgtaatcctgtggagtcatcgtcttttcctctcctttggggccgtcagatcataactgtgggcgatcatgccgtcgagcgcatcgtcgtccagtcccgcgttcagcgtcactgtgttccaatgcgtcttgttcatatggtagccgggcgccacctgaggatacacctgccgccagaactgagcctgcatcggctcacatttgagattcaggcacaatttcccgtcacgttcaaaaacaagcgcgtaacagcgccggttcgcgcatcggcgcaccgccgtccagttcgggtcctcaaacggctgatcctcataaacatccggaaagcataagcagcgctccaacagctcccgccgtgtcacagcctacgcctcgtattccattttttccggcgtccagtctgtgaggaccgcctgcatttcctccgcggctttgcgcgcgcccgcaagatcgtgctcgcggtaatttccgcattccgcctcggccgcgccggggatctcgccctcatacgacgcgataaaagcgaacgtctgcttgagcagatcgatcacctcctgcctggaaatgctgtcgcgcgtcagaaaataaaagcctgtacggcagcccatcggccccacatagatgatgcggtcgccataggacgtgttgcgcacgtacgtcgcgaataaatgctcatacgtgtgcagcacgccattggaaagataactgccggcgtttggtctgcgcatacggatgtcgtatgtaacaacatcgccgtcgacgcgcgagacataaagtccaggtttcagtttggtgtgatcgacggaaaagcttgcaattcgttccattgataatcagtcctccaaatacggcaggatgacccggtatgcctcgcacagccggtcgaacgaacaggcgcagttggccgggcttgtcgacggcagggcggcggccgggatgcctgtcgcagattttatatacttttcgtatagatcaaatgctttttttccagttgtaaaaatcgcacggatatcgcccgcgcgcagaatcggggaaaggtcgtttggctttgggtctttaatcgacgcgtcgcttgcgccggtaatcccgcacgattgcagcacgtcccacagcgcgatgcgccggcttaacatcagggcggctttttcttcgttcgaacgcggcgcaggtacgtccaaaacagccgccatcacgcgccagaaacggttttgcggatggccgtaaaagaagccggacgcgcgcgatttgggcgacggaaaggtgccgagcagcagcacgcgcgagcgcgcgtcatagaccggcgcaatcgtatggacaagccgcgcggcggacgcgccagacggcatagcgccgctcacggttttttcgcagcggcttccagcagcatggagagcgcgtgcgacgcggcaatatagcggatataatcgcgctcgcccgtctcaatcccgcgtccgagacgaagctctttcacatcgctgtaccactcgctgctcaccgccacgtacaccagccccaccggcttttcttcggtgccgccgccgggtccggcgacgccggttgtcgaaacgccgatatcagccccggccagccgccggacgccgtcggccatttcacgcgccgtctgttctgagacagcgccataccgcgcaagcgtctcgcgcgcgacgccgagcacgcgttccttgatctcgttggcataacttgtaacgccgcagtcgaaaacggccgagcagccgggcacatcggtcagccgcttggatacatagccgcccgtgcagctttcagcacaggccgcctttaaacccttctccgtgagcgcgcgcacagcggccgtctgcaaatcgcccacatcgacgccataaatatactgcgaaaaacgctcgcaaagcgactgcacaacaggcgcggtcatctcctccgcctcctgctttgtatgcgcgcgggctgtgacgcgcagcatcacctcgccgtccttggcatacggcgcgagcgtcgggttctccatccgctccatctcatcgcgcagctgcgcttcgagcgcgctttcgccgatgccgaaaaagtgaatgctgtgcgatacaagcacatgatcggagcggcgagccagatagggcatgacctgctcgcggaacatcggcagcatctcgcgcggaggacctggcagcatgatcgcggttttcccgccgccctccacaatcgcgcccggagcggtgccgttgtggttttccagaacgatacagccgcgcggcatcatcgcctgtttgaggttgttttccgtcatctggcggcccaccttatggaaataacagtgcaggtgcctggaggacggctcgtgcagctccagcggcacaccgaaataaccggcgatcgtttccttgcttaaatcgtcgtaggtcggcccaaggccgcctgtcgtaatcacaatggagctgcgttcaaacgccgcggcgagcgcctcgcgcaggcgctcgggattgtccccgacaaccgtgtgccggtagacgccgacgccaagctccgcaagcccgcaggaaatctcccgcgaattggtgttgacaatgtttccaagcagaatctctgtgccgatgcacaaaatttcagcagaagcgttcactggaatcaggcctttcaattgataaaatcgggatatatgcacagcagagctgtttgctccgccgttatggcgccgcggcggccagtcccttcgggcttgtctgccgcgaagcggcatggtataattgcccatcagaaggcggttgccgcgcaagcggcgagccgctgggcataacccggtataataaccgctctgcggttattataccacagaatgaagccctatagcgaatattcggaaaaattttgtaatttgatgcttcaccacactgatagccctttacgcggagacaggctgtgtggtatactgtttctataatcggggtggtatgcaaaaaaatgcagccgggggcctgcacaggacaaagggagaatcagaacatggcgcagtacagcgatttattgctttcggaggaaacattgaaggccgtggagcgcatgggctttacggagttgactgaaatacaggaaaaggcgatccctgtcatgcttgaagggcgcgagatcattgccaaggcgccgacaggcaccgggaaaacgtgcgcgttcggcgtgccgattatggaaaaaatcgacccgtctgctctggctgtgcaggcggttgtgctctgcccgacgcgcgagctttgcacgcagattgtggacgaattgcgcgagcttgcgcattttcgtccgcaggtgcgggtcgcggcggtatacggcgggcagcagatcgacaggcagatcaacgccttaaagcgcggcgcgcagatcgtcgttgcaacgccgggccgaatgcttgaccacatgcaccgccgcacgatcaacctttccaaggtgtcgatcgctgtgcttgacgaggccgacgagatgctcgacatgggattttataaggacgtatgcaaaatcctggatcgcctgccgaaggagcgtcagatggtcatgttttccgcgaccatttcccgcgaggtaatggatatcggttggctttatcagcgcgacaccgtcgagctgacggtcgagccggtcaaggaaagccagccgaaaatccatcagtatatgctcgagagcgtcggccgccaaaagctcgccgacctgtgttacatccttgaggcgaacgattttcacaaggtcatgattttctgcaataccaaatattcaaccgcaagcctgagcaatttgctgcgtgaacgcggcttcaatgccgattgcctcaacggcgacatgcgccaatccgagcgcaaccagattatggcccggttccgttccggcgagatcagcatccttgtcgcaaccgacgtggcagcgcgcggtatcgatgttctcgatgttgacgcggtctttaattacgaaatcccgcttgaaaacgaatactatctccaccgcatcggccgcacgggccgcgccaaaaaggaaggggtgtcctatattttctacgggcgcgacgagctgccgcgcctgcgtcccattattcgttacacacgctcacgcgttatggagcttgaattcaacgaatctggcgagttggtggaaaaggggttgttccagccgtaaaggcggacggtcagccgcaccgcgtcccgtttatgcgggacgcagtttttgttttcaccgtttgcagcgtgacccgtttcagcgccggagccgtgccgctgctcgcggcgcagcctgtttttgcgcagcacccgccccgctgttcgcggcgcagcctgtatacgcgcaccacccgccccgctgttcgcggcgcagccgactaaagttttttgtcttacctttttttcaaaaaaggtaagtttcaaaaaagcgggggaaaggacggaagggggtcgggaccggtgaacaccaacccctgcataccgcagtcccgtgcggcggcaatgttctgttcgttgtcgtcaataaagaagcattcggctggctcaagctcgtatgtagaaaacagcgtttcataaattgcgcggtcgggctttacctgccggacataagctgatacaatcacgccgtcgaaacagtcgtatacggggatttgtgtgcggtagcgcgcgaagcgcacgcctgcgtttgaaagcagatacagcttatatccccgctctttgagggaacgcgcgtaatcatttgtctcctgaatcgggccgaaatagtgatcccaattgcgaaacgcctcctctgccgcggcatgcaggcgatccggcatcatggacaggatactggaaagcgcatcctcctcatcaatggaccctgcgtcaagcgcataccactctggtccggagaacacatgctcacataacagcttttgatcctcctggctgctggcgaaatgagaggccagcgccatgggatcaaaccgcatcagcacatttcccatatcaaaaataatatttttaatcatatgcattcccctttccggcccgcaggcccagggcttgttagaaaatagagaatagcctgatctttcgcagacagcaggcgggcgcatggccaaaacgcaggaatcctttcggattcccaggctttttaacacagcattcgccgctgttttccggaaaaacgggtattttgatttttcaaacaagcccccaagtcatgtgagggctgtttccagtgtgataaagtgcactgtgtttccattgtccatgacaatgcgcaaaagatcatcgaacgccagccagaccgtcgcggtgttgtcgttcggatggacgcccacacgcggatttccttcaagcgaccggtcgaatacaacttcgacggcggcgtccggatcgttgataataccgagcggcgtcacctctccaccaatcagccccagatatctttgcaggcgctccgcggacgcaaagctcagtcttgtcgagccgagctgcgtttcaatcgatttaagatcggcgcggcaattccctgggatcacaaccaaaaaatgacggcggcctttggcgtcgcgcaggaataaatttttacaaaccgtcccgctgccggtcagccccaactgctccatatcctcgatggtaaaaacggccgggtgctccgtcagctcataggcgacgccgagcgcgtcgagccgggcgagcgccgcgctgcggtcagacatttaaaaacccccttgcttcctttttacaaaatgaccgctaataagcccattttatcatacccatatgggaattacaacgaaaacagctttttcctcttgacgaaacgtaaaaaagcagtataatagcaactacaaaaaggtttgcaaaaaactgtgaaagacgctgaaaagaagagtaggctgtcggaaccgcagcagagagcctcggttggtgaaaagaggcgcgggaaacacagccgaacatggtcttggagtcccgcgggcgaaagcttttagtccgcggcgggttcgcccgttaaagcgacaggcggtcggtatcgagccggacgccggtgaggctgccgcttaaatgcggcggcgaagcagggtggtaccacgaagcggcgctctcgtccctggacaatttgtccgggaacgagggcttttttgttgttcctgccgcgatgcgagcgggatgttggagggattgctttgataaaaatcagcgacgtatcaaaaatatttaacgataagtcaggagaggtggtggcgcttcgcggcgtcaaccttgagattggcagaggcgatatcttcggcatcatcggcatgagcggcgccggcaaatcgacgcttctgcgctgtctgtccacactggaaacgccgaccagcggttccatcacgctcgacggaaccgatcttgcgtcgctttcaggcacgcgtttaatcgaaacgcgccgcaaaatgggcgttgtttttcagggctataacctgctgatgcagcgcacggtacatcaaaatattgcctttccgctcacgctcggacacgccgccaaagccgacatcgaccggcgcgtcaaggagcttcttgacctgatcggcctggccgaccgcggcgacagctatccatcgcagctttccggcggtcagaagcagcgcgtcgccattgcgcgcgcgctcgcaacaagcccggaggtgcttctgtgcgacgaacccacttccgcgctcgattccctcacgacaaaaaacatcctggagcttctgcatgatatcaaccgcaagctgaatgttacgatcgttattatcacacatgaaattgccgttgtgcgggccatctgcaacaaggtcgctgtgattgacgcctctgaattcgtcgaatggggcgacaccgcagagattttcaagaaccccaaacacgatatgacaaagcagcttcttggatatgaggtgatgaaagaatgatggagcttttgcagcgatacggtcccatgctgctggagggcaccggcgcaacgcttgtcatggtgctcggttcaaccgtctgcgcctacatactcggcctgccgatgggtgtgctgctgcgcgtgaccgaccgcggcggcattatggaaaaccgtgtattcaattccgttttcggctggatcgtcaacatcctgcgttctctgccgtttattatcctgatggtggcgctctttccgtttacaaggctgatcatgggcaagatcatcggtacagccgccgcctgcgtgccgctgaccatcgcagccgcgccgtttgttgcgcgcctggtggaaagctcgctgtcggaaattgacaatggcgttgtggaggcggccaagtgtatgggcgcgaccaatggtcagatcatcctgcgcgtgatgctcccggagtcgctgccctccctgatccgcggtctgtcgatcaccaccatcacactgatcggctattccgcgatggccggcgcggccggcgcgggcgggcttggcgatatcgcgatgcgctatggctttcaccgctatgagccgaaggttatgatcctgacaatcattctgctgattgtcatcgtctgcctgatacaaatcatcttcgaccaccttgcggcgcgcgtcgataagcgcaaccgctgatccattcatccatcgccggaatgcggccgcttccggtatgatagaaatcttttgattaaaaggagtctcaaacatatgaaatcgatcaaacaactctttgcgtgcgcgctggccctgacctgcgcgttctctctggccgcctgcggcgggtccgccgcgcctgcttcctcgtccacgcccgccccggcgccgtccacagccgaagcgtccgcccccgttgacgccgacgcctctgccaccgtcgcctcctctgaagcggcggcggatgcttccgccgtccccgccggcgccgtcacgatcaaggtcggcgcgtccccggcgccgcacgccgaaattcttgagagcatcaaaccggctttggccgccgagggcgtaaatcttgagattgtcgaatttacggattacgtcatccccaacatggcgcttgacgaaggcgatatcgacgccaactacttccagcattatccgtacctggctgatttcaacgagaaaaacggcacggatctcatctccgccggtgctattcattttgagccgctcggcgtctatccgggcaagacggcttccatcgaagccctggccgacggcgcgaccattgcggtccccaacgacgccaccaacgaagcccgcgcgcttctgctgcttgaaaagctcgggctgatcaagctggccgacggtgtcgggctggccgctacgccgctcgatattacggaaaacaccaaaaatatcaagtttgaggaaattgaggccgcccaggttcccaacgtgctgcctgacgttgatttggccgttatcaacggcaactatgcgcttggcgccggtcttgccggccaggtgctgacgactgaggacaaggactccgaggccgcgcaggaatttgccaatgttgtggcggttcgcgccggcgacgagagccgtcccgaaatccaaaagctgatcgccgcccttcagagcgacgagacagccgcctttatcaatgaaaaatacaacggcaccgtgatccccgttttctaagctcccgctttcccgcttttttgaaaaaaagcttggcaaaaaactttagccggctgcgccgcaaacagaaggcttggcgcttcgcaaacaaaagttttcgcccgcctttttcaaaaggcggcgggtgagaaaaaaggcaaggccccttgcgggtcttgccttttttcgagggcagcgccctgatctttgggccgcagccctcataaaagcgcggcccgcaggccgcaagacatctgctgggacgctccgtccgtcccaagcaaaatccgtgacagacgccgcgcggctggacgcggattttgcaggctcctgtttccagtcttttttaaaaaaatctcggcgaaaaactttccgtcttttttgaaaaaaaagccccggcaaaaaattttagccggctgcgcccccgcttttttgaaaaaaagctcggcaaaaaactttagccggctgcgccgcgaacagtgggacagccgctgcgctcatacaggctgcgccgctttttattcgcctgaatatggactgcctcacagggaaaactgatcacaggtttaaaaatacaaggaggcgatttcttgaatctgcaaaaatgtgctgtcatcggctgcggcgcagtcggtgcaacaacagcgtttactctcttaaaaagcggcctgttttccgagctggtcctgctcgacatcgatcagaaaaaggccgaaggcgaggcgatggacatcgcgcacagcgttccctttgtgcggccggtcaacgtttatgccggcgattatcccgatttggccgacgcgggcatgatcgtcatcacggccggagcagcccaggcgcccggcgagacacgcatcgatcttgtgcgcaaaaacgtccgtatattccagtcgatcgtgccgcagatcacgcggcacaaccgcgattccattctgttgatcgtcgcaaatccagtggatattctaacgcgcgtcacactcacgctgtccggctttccggcgcagcgcgtcataggctcgggtaccgtgcttgacactgcccgcctgaaatatctgctcggtgagcatttggaggtcgatccccgcaacattcatgcatttatcatcggcgagcacggcgatacggaactgccggtctggagcagcgccaatgtttcgggcatcgatttgattgatttttgcaaggtctgtggaaaatgcgccgatatgtccggcatccgcggactgtttgacgaggtgaaaaacagcgcctaccgcatcattgaaaacaagggcgctacaaattacgctatttccatggcggtgctgcgtattgccgaggcaatcgtgcgtgacgagcgttccgtgcttcctgtgtctgttctgaccgatggccattatggcctgcatgatgtctgtctcggcctgccggcaattgttggacgcagcggtatccaaaaaattctggacttcccgctgaacaccgaggaaaaccgcgcgctttccgcctccgccgccgcgctctcagaggtgctttccggcctctcaatttgattagcactcaatgtataagagtgctaaaattttaaatttattcataaatcatgtctggttttgtaacaatcatccagtatactgtaatcaatgaaacaagagaaagtcctttagaggacagaaggaagatggttgcaatgtatcggatcaatatccaccgataaagcggacagtataccgcacagatcaggaaaaaagcagcagtttttttgaaaggggttttgatttatgtttgacctgatgccttttgaacacaagaccagaaatatagcgaacttttttgatacgtttgaaaaaacattctttaacgatttcccggctggtttttcggaaatccgcaccgatatccttgataaaggcgaccggtatgtgctccaggcagagctgcccggctttgataagcaggacatcaaaattgatctcaatggcgaaacattgacgatttcggcacagcacaatgccgaaacgagcgaggacaaggacggctatgtccgccgtgaacgccgctatggttcttttgcccgcagctttgatgtctccaacattaatacggaggcgatcaaagccgcctataacaacggtgtgctggagcttgacttgcccaagcggacgccggcgcagtctcagacgcgccagatcgaattgcagtaaagcaaaccatacagccccggccgcgcgcagctgcgcgcggccggggccttttttttgccgggttgtccttgggctgcaaaaaagctttgggttttcagcccaaagcccaatggtatttccgggaaaaattttcccccgcgctgtaaaaccgctccattcaccacaaatttgtgttatacttaataaaaatccgctcatgcggcaaagggggattttcttggcaagcgatctgaaatttgcagtcctgatcgacgccgacaatgtatcggacaaatatatcaaaattattctggatgaaatctcaaacgatggtattgcgacctataaacgcatctatggggattggacaaaacccgcgctcgtttcatggaaaagcgtactgcttgacaattcgatcctgcccatccagcaatacaattacaccaccggcaaaaactcaaccgactccgccatgatcatcgacgcaatggatattctttattccggccaggtggacggcttttgcattgtctcgtccgacagcgatttcacacgcctggcggcacgtctgcgcgaaagcggcatgattgttgtgggcatgggcgaacgcaaaacacccaaatcgtttatttccgcgtgcaaccgctttaaatatctcgatattcttgcgcaggctgaaccggccgtgcaaaaggatgaggactgccagcgcgaggacgcgccccggcccgccaataagaaggatgcggacaagcccgtgccggcgcatatggaaaaggaagcggccagggaaaacgcaaaggctgaagctgacccgtcggccgccaaagagatgaccagcctgaaaaccatccgcaaatcgctgcggatgatcgtctcggaaaattcggatgaggatggctggctgttcatcggcaccatcggcaatctgcttgtcaaacgccatcccgattttgatgtgcgcaattttgggcattccaagctgacgccttttcttgaatcgctcggcctgttcgacgtcaaaagcgtccgcacgcgcgacagcagcgtcaagctgatctatgtccggttaaagtaaacgcacaccgaaggaaggtcgcgcgcaatccgcgcgcggattgctcaccgccgggggcgcgcggcctgtgcgcaggtcgttcaccgccgggcgctgcgcttgcccgtccggctattcggggctttccggcgctatagcgccgggcgcggacaagccgcggctgcgccccttttcgcataacacaaggggagggccggcggccctccccttgtgttatccccacctctgtttggcgagatcgcatcaggcgcacgccagtacgtttgattgtaaaccgtcaagctgcgcctgccccgctgttcgcggcgcagcctgtatcaaggcatacggcacacttggcaatatatccgccgcctgtatgtcagtttgcgggccagaaccgcgcactgactgcgaagaaggaggaactgtattgattcggaagattatagctatttttcgtgtgccgtcggacgagttgaccatcgccatcgctgactccatcctcgatcacaaaatgatcgtcaattatgagagcgtgaatttggaaactatggagccagtactgccatatgagtcctttgacaactttgactgggatgtacagtttactgaatcgccaaacaccttccaattgtatttacagtgcctgaatccgctgatctacctaacaaaagcctatcagttgacctccgatgcggcctatattgattgcgcaacggaaatgatccagagttggatagactatgagcaaacgcgaggcaattccaaaaatccatttgtgtggtatgaccatggcaccgcgctgcgtgccgaaaatttgatctatttcattctggcggcggagcctgatcagaggatcacgacggaattctctcgggaattacgagaactacttcaggaacatgcggaatttctgagtgccccgcaaaactatacagaaaaacacaatcacggcattttccaggaccgcgcactgatctatacagcttattttctcaataacgatcaaaccgcgcaatggcttgaaatcgcgcaatcgcgtcttcaggcccaaaaagaatttgccttttcagacgagatggtccatgtagaaaactctcctggctatcagatggcagtgatggatctgtttcgtatcgtggcggacttcctgaagaccatgggaaatccctatggaactgatctttatcagggcatggaagcgtccgcagaatttatggcccaaatcgccaagcctaatggttttctggcagagatcggggatacgaacggccgcatcacatcttccacgatttccaacgccagcttgaccgaatttggcaacccgcatctgacttattcctctacccagggtttacaaggggaaatgccggacagcctctcggccttttatcctcattccggatactacattggacgcaattcctgggcggcggacggcttttccgatgctacctggacaatgttcaagtccgggtattcctccaaaatccataaacatgcggatgatctttccttcatgctctactctcacggatatgacgtgtttgtggatactggctggtacaattatatatctggaaatttttaccgcgatcatttcgtatcctcccgagcacacaacacccttattgtagatggaaagagttactctcctacagataaaaacagctccaaaacgggcatcttccaaaccgcctccgaagacggatacgactatgttctgggcttcaacgaaatgtatcccggtgtcagcctggaccggcatttctactatttagggaacgcaatcctgctctacgacaatatggtttccacggatgaacacacctactcccagctctttcagtgttcagaatatacagaaattgcagaatcatcatcaacaaaagtactgctgcgcttggcagatacgggctattatgtacgtatccgccagttacacgcctccgggccgcttgatttcaatgtctatcacggggatacaaaaaccggatatggatttatctcccgacaattgaaccatgtggaagaaatcaacaccttgaaattcgatacggtcggaacggattatgatctggtgactctcatcaccatagaagacgcttccggcgcaacggaagggatggacaaattctcatttgatgaaaaagctatgactttctcttggtccgacggagaagtgaaccgacagatttctctcacgtccagacaacgagtagatcctatggctgtctctgtatcccagcaggataacctatttacgtttacaaatcagaataccatcgacggcctacagtacgcttggtatattctggatcgaaataccgcaaaggtacctttcaaaacggattattccacagacccgcaactttcctatcgctttgatgaagcaggaaattatttggtaaaggcctatgtccgttcgaagaacggacataggcgatcggctattacatccgcagtggatgtaaatcctgaaggaatcgccaaggatgtaaccaatgcatatccttatttaaatttgcaatacaatgggcagaagatggagcctttaagcgattctcagtatcgatttatcattgattatgactattcttggacatcctccgtattgtggtatgtatatcgcaacggtggttattatgattctctacgcacggacaacggcattttagattataccttcactgagccgggccaatacacggtcatgtattatctgaccaccgctaatggggacaatgaattctggaacttttctgaaatccaaatcccttccaaatcataacagcagcttgtttttctccaaaaaccgttgccgcccgtctaattctatatggattggagcattagataaaagctgttttcgcagctttttctccgattcaaattaaaaaataaagacagacaacagcttctatatagagctgttgtctgtctttatgcttttagaacaccaatcacatatcagtagggtagatattaagcagcgcctgccccgctgttcgcggcgatgcctgtataaacgcagtgccaaacccactattcgcggcgcagccggccaaagttttttggcatacctttttttcaaaaaaggtatgaagtttttcgccggggccttttttcaaaaaggccggaaccgtcatgcgtgaaactgctctacggcgtcggcggcggcgtccatccaatcgccctcgaacagctcgatcacgccgctgtcgcagttggaggcgagtgaaggatcgatggggattttggcgagcaccggcagcttgtaacgcgcggccgtttcgtcaatatggcttttgccgaacagctcgatgcggcggccgcaatcagggcactgcacatagctcatgttctccaccaggccaatgattgggatattcatcatctgcgccattttaacggccttttccacgatcatgccgacaagctcctgcggcgaggccaccacgacaattccatcgaccggtatggactggaacaccgtcagcggcacatcgcctgttccggggggcatatcgacaaacagaaagtcgacgtcgttccagacgacatcggtccaaaattgctttaccacgcccgctatgaccggtccgcgccagacaacaggatcgctgtcatcttcaagcagcaggttgacggacataatatcgacgcctgtcttgctgcgcgcggggatgagcgcggtcccggttgaggcggctttttcgcggatgccgaacgctttgggaatcgacggtccggtgacatcggcgtccatgataccgacattgtagccgcggcgcttgagcaatacggccagcatcgaagttacaagggatttgccgacgcctcccttgccgctgacgacgccgattacacggcgcacacagcttaattcattcggcgcctccagaaaatcagcgggatcgctctgcctgctcgggcagttttcaccgcagcttgaacagtcgtgcgtacattcgctcatgttgttttgcagctccttgcatagtaagattaaaataagtataggatttccagacagctttgtcaaatacgcggtcaagcaaaaaagaacgtcccctggggacgttctttttatattcgctctatatcaaaaccgcttgccgcgggaaaaacttggactgccctgcccgccggaccggtgttccgcccatccggcgggccgacatgtgaaaaaagaggtagaagaaaagagagagaaagtaatgaataaaggctggagaacgtctttactttttattctggaggatacaccgcctttccttttggagtggtttcagtataccggccgaatgtgaaatccgtttgaagtttttttgacggttgcttaaaacttccatggataaaatgcgaaaggcccccgccgttatggcagggacccttcgcgttgatatgggaaagaagaagtaagtcggcggtcaattttttgcgggctgcgtttcggctgggtccttgagaaccatgtgcagaaggatgttgagtacgacgccgcagacaaccgcgataaacacgttgttgttgacaaacatcttgacaaacgggtggaaggaattggcccactccgcgcctgtggtggagaaaaacacaggcagcatcaccgctgtgccgatggtggtcccggcgatcaggttgttgcgggcgtcgcgcgcttcggaaacgacaacgtcgatgccggagaacatgatcatactcgcagagatcaggaacacagcgccaacgaccggacgcggaatgcaggcgagcatctgcgcaagctttggagacaagccgtaaagcaggaacataaccgccgccacccgcacaacgcggcgggacgcgacgcctgtagcggccagaatgccgatgttctgcgtataacttgtgaccggcagcgcaccgagcagtccggaaccgatgcagccgagtccctcggccatgatgcccttgttgatatgcttgacgcggtaaacctgatcgcagaccgcacaggtggcggcataatcgccgattgattcaaagatcgagccgatatagccggtaaagcccgccaggatcgcggccgggatcagcacaaacggcgcggtcgccccttcaaagttgcggaacgggaaaagctgcggcagggcaaacaggtcggcctgaccgacaagctcccagtcgaagataccagcgaccgatgaaacaacgatgccgacgatcacaaccgaaatcagaacgaagccctgggacagcagccccttacagcggaatttaagcacaagcgccaacaaaaaggcaaccaacgccagaatcaggtagaccggctcatgcgaagcgaatatccaacccagggctattttagccgcaacaaagccgatcgtcgctacgaccgacccggtcacgacaggggggatgaatttgcgcaggcgtcccagtatacgggaaacgccgatgactgcttcaagcgcgccgccgacaagcacagcaccccacattgcggggaacccgtaggtggccgcgacgccgcccatcgcggtcaaaacggacgaggacggtccctgtacaaccggcaggcggtttccaatggtcgtctggagcagagtgcctacgcccatggcaagaaaacaggtgcggatcataatcgggagtatcgtttcagatagacctgccagcgatacaaacattccggcccagataaacggggtgaagtcgacaagcgtaatctgccatgcaaaaaagagggtctgccaccagctcttggggttttcatcgactccgatcgtcacctttaccgtgctgtccggctgtttatcaaaaataggctgctcaggattatacattgcttttccctcctccggttgggcagccgtccggcagcggacggctgcggtttacacctgatggttacagcagtgaagccttgcgttcaaacgaagcgatcacgcggccgcggcgcaggatgtacggacgcgacgcgcgcgtgcgcagcgcctcctgaatattgtccgcatcgagcaggttgaggtctgcgtcgtttccgacctcgatgccatattttgcgcccggatcaaatattttggcggagttataggtgagcatatcaaagatcaatttcgcggtgcccggtgtattatactgtgcggtgtacgcgcctacaaggccgtaatcgagcggatcgcccgtgccgtacagatggaatccgtcgcagatcgtgtcctgcgcggtggcgacattaatgcccatatcgaccatctcgcggatgcgtgtgacgccgcgcgtgcgcggttcggcatcgatgcccatgatggcaagcacctgcgtattggtgcagatattcatacctgactccttgatcagcttcataaccttgatcgcgtgcgactggttttgataggtgatcgatgtacagtgtccgcctgtgacgcgcggtccccatcccttctgcatggtcagccatgccgtatattcaagcgagcggtcaaacatgtccttggactggtcgatgtgcatatcgatcgggacattgtatttttcagcgatttcaaataccaggtccacatggctgcgcgcgtgttcgtcgagccattcggccgcaggcatgccgcccaccacgtcgcagcccatctccatggcctgccacatcagcttttcggtgccctcattggcataaataccctcctgcgggaaggcgatgacctgcaaatcgcagatgtccttgcaggcttcctttgcggccagcacaccctcaaggccgaccaggtttgccatattgtcaatgtccacgttcgtgcgcagctttgtcgtgccgtacatgacacactcacggatggcccgctcggcgcgcgccttcacatcttcaacggtgtagcgccgcttgatgtcgtgcatgatatggatggaatcctccagcgtttcgacggtactttcacggccggcgagcgcggtgtatgccttgtcaaaatgcatatgtgtgttgacaaacgtcggtgcggccagcataccattggcatcgatcacctcaagcccttcgatgccttcggaattgatgccgggtcggatttcagcatatttgccgtcgtccccgatcagaaggtcgttcataccgcgtccatccgcaagattcgcattgcgtatcaagagcatggcgtccactccttttctattttgttttgctttggaatgactccatcatagcaatccgtcattgcgatgtcaaattttttatgttaaaattgcacgtaattttatccttaaaacaacacttttttgccaaaaacaacttattaattgcgcaattaagaaagcctttgtttacatttcattttaattgctgtaaaataaatacaaaaaatatgcttatccctaaaaaaatctgatttttacagcgtcttatgattgacaggcaagaccatgcggaatataaaacgcttttacgcacggcttgaggctcaaggagggtgtgaagcaatgatcacgattcatgatgtagcagccgcctgcggcgtctccgccacaacggtttcacacgtgctgaaccatacgcgccctgtcgacccgcagacggccgcccgggtgcgggcagccgtcgaaacgcttgggtaccggccgctgcgcaaccgcgacaaatacggactgcgcgcctcccgcaccgtcggcttttttgcccacggcgctggaatcactgcctgcgccgacctgcttgaacgcctgcgcggccaggtgggtacacaatgccgtctgatgctgatctgcacagagcaatcgctgtccggcggtgaattgcgagccatgcaaatgttttaccgcctgtcgctgtgcatcctgcacaactctgtccgcatcagcggcgcgggcgtgtcctcggacgcctatccggttcccacgctgctgttaagcagccagccggcggacgcgcccaacctgcgctgcatttcgtttgattaccgccgcgcagcgcagatggcgctttcgcatctgatcggccttggacataccgaaaccgcatttctatccagtatgcacaacagcacggtcaatgatgaaatccgcgattctgtccgtgcttttctgcgcgagcatgggcttgcctttcgggaggattattatttcgagcttcccaccacgcccggtacagcgtccacacaggcagcgctcgactcgtttttcacatcccatccctccctgacggcggtgattccagtcggcgcgtgggcagcggcctgtatagccgattattttctgcggcgcgagctgtccagcccgcgcgacaaatcaatcgtcgccatcggtgggctgagtatcctggaggaatacagctcgcatatcacacgcgtcgatatgggcacagacagcctgctcgccgcgattgccgcctggatcgacgcgcagggcgcccgggacatccccgcgcgaatcgcgcccgtgttccatccgggcgccagcacacggacgctcgcccgcacaccggctggcgcgcccgcctttgcacccgagacgctggagctttcgtccgacgaattgcagcgggtgcgcgccggaagctttaccgtctgcgtctcgcttgacaacggcgacgcggcctttttccagctcgtgctgcgcggcctgcgcgacgccctcaccgatctgaatatgacgctgcttgaaacggctgaagcgcacggcagccttgcgcggcgcggctcgcagctgaagtatttcgcccatctctcgcccgatgcgatcatcagcttttcaaatgaccagacgcctttgcgcgatcaattcgtcgcactggccaacagccggtccaagctcattctgggcgtcgacatgccgcccgatctgccggaatatgcctgcgcgtcctgcgtcgccaccaacgagccggaaaaaggccggctggcgggacgtctgctcgcctccgagctgattcgacgcaaaaggcgccgcgtcggctttatctgcaacgcagacgtgaatttctgcgcgcgtcagcgcgacctggctgctatcagtacggtgcgcgaggattttccgcagctcgagatcgtctttcgccatgattttcttaacgagcgccaagccgcggacgctgtgcgccaggcacttgacgcatatcccgatgtggacggcgtctatatcttttccgcgcgcgccgctcttgaggcacagcggctgctgctcgcacgcggccgcggcgacgtgctgcttgtcaccacccagatcaatgccgaaatcgccggtatgctgattgaatatccgaatctgcttgggatcatctcctcgcagggctatgaaatcggccgctgccttgcgcttgcggccgccgtcagcctgattggaaagcagccgccgcgctatgtggcgctcgatcccgtcaccattaccgctgggaatctggagcgcgcctgggtgcgcacggcgcgtttaagtccgccggcgcagtaagaagcccggacgcgccgcgcgcgtccgggctgtttgtttgaggaagggcgcctacgcctgcttattggatgtgcgcagcagtgtgcggtatttatacgcaaacagcaggcagcaggttgtcgcggccgtgatatccgcgattggttcggccagaacaaccccatccgtggccggcgttatgaaatgcggcaggatgataacgagcgggatcagcaggatcagcttgcgcagcaaggcgataaaaatcgatacctttgcctgtccaagcgcgataaacacttgctgcaaggccaattgtacgccgaaaatagccatccccagaaaaaagacaggcatgatccgcgcggccagctccacaacggccgggtcgtcggtaaagacgcgcacgggaagctttgggaaaaacaccgcgacaccccacagcagcagactgaacgccaggcagaataccgcgcagtactttgcagccgacttcacacggtcgtaattgcccgcgccgtaattaaagccgatgattggctgcgcgccctgtgcaaaccccataaccggcatcgtaaaaaactgcattacgctggacatgatgacgatggcgctcacatacaaatcgccgccatacgactgcatcgacgtattaaaggcgatctgcacaaggctctccgtgctctgcatgataaacggcgacagccccagtgcaagcacacttgccatcacacgcgggctgatgcgcagatactgaacgcgcaggcgcagcgtgctccgcctggaacagacaaaccacagcacccaggctgcggaaaccgtctgtgaaataatcgtcgcgagcgccgcgccgcgcacgcccatatcgcaggcgaaaattaaaatgggatccagaatgatattgagcgccgcgccgacacagactgtcgccatcgctgttttcgcaaagccctgcgccgaaatgaactgatttaagccgagcgccagctgaacgctgatggtaccgatcagatagacgctcagataactgtccgcataggggagcgtatcgtcgcttgcgccgaacagacgcagcagcggcgtcttaaaaagcagaagcagcgtcgtaagaaccagcgcgagcaaaacaagcatggaaaagcagtttcccagcagccgctgcgcttccgcgcgcttgccggcgcccatgcggatggaggcgagcggcgcgccgccaaagcccaccagggctgcaaacgccgaaataatcatgatgatcggaaaggtcagccccacgcccgtcaaagccattgtccccgtcaccggaatgcgaccgatatacatgcggtcgacgacgttataaagcgcgttgataatctgcgcggcgatagccggcgcggaaagcgacagaatcaacctggggatgttctcattggcaaatcgttcgtccatggactgcttcaatgctgttcacccgttcgtacaaagtcatactaacattttatctatcttatcacaaaagtatgaacagattatgtatgcacataatatcagcgcccgctgcatttcccgggaaatcacgcacggacggcgcggcctgtcaatggaccttcagcctgccaagcgccgccttgtcgctggcccgccggaacacgtgaaagctgtttgacagaaattcctccatgcagagaagctttgccggagcgtccgaaatggacgcctgcgtcatatgcgcccacgcctcgttgagcaagacccgggggcgcaaaccgtatggctgtccccgatcgcagcggcggcggtattataaccacggctatgccctcatttaaatttgttttatttaaaattttaagcccccctgttttttacaaaataggggggctttatgcttcaaacgagatgcaattcgacaccaagcccatgaatataatcgcgccattcctcagaaagatttttgtctgtgatgatgatgtcgaagtcggacagatacgcataaaaggcgacgcgcacaataccgaatttgcttgaatcggccagcaggatcttcacgcgggaggcgttgatcgcagcgcgctttgtcgcaacttcgtaatggtaagcgcaggtgatgccgagcttgccgtcgacgccggatgcgctcataaacagcttgttggcgcgcgtggcgttgatcagggagattccctcgggcgattcaaacatctgcgacgccttgtggtagtagccgccggcaaagatcaggctgatacagtcgtctttttggagcatctggagaatcgaggagctgtagcacagcgcagtaaaggaaagccccggcgggatatgcggcggaatcttttcgacggtgctgccgacgtcgatgatgacaacgtcgttcggttcgatcagcgaggcggcgaaccggccgatgcgcgccttttcgtcggcatggcggctgttttcgtcgctccattcatagtccgcgccgatcacgggcaagttgcttttctcattgtaaacggcgacgccgtgcacgttttccgcgatgcggttgccagcgagcgtatccagatcacggcggatcgtcatttcggaaacgccgagctttgacgacagctcccggatcgggatggcctttctcgatttaagaagatcgatcagcgcgttcaggcgcatcatttttttgtccatctgtattgcccctctgaccgactggtctgattttgttatcagtttaacataattatatcaaatttacaatatcaaatcaatttccagggaaacacacatcgacagcaggcccttctttgttgtaatccattaattattatgtttattttttaacacttatcgctgcaatcaacacaatttgacgttaaattgaacatatcgacactatatttcttttataatgttgacaataattcggcgttttgactattttatttgattttgctcttgaaatagtaaaatcaactgctaaaatgttaattaaagaaactcaattttgtataaatgttaatttcaaaacatttatacagcgatccctttgagccttgagaggagctgatcaaatgcaggaaatactggccggtatgatccgaaccgccacgccggtactgctggcggcgatgggcggcctgctttgcgagaaagccggcgtctttaacatcgccctggaggggatgatgctgttcggcgcgtttttcggcgtgctcggcgtctacgccaccggcagcctggccgccggggtcgctgccgcgctggcggtcggcgcggcggcggggcttctttacacctttattgtcgaagaactgcgcgccaacgccaccatcgtttccattgggcttaataccttcgccgtcggtatcacgacctatctgatgaaaatcgttttcggcgacgcgggttccgtcggttccgaccggattgtcgggctgccccaggtggatatccccctgcttgagaatatcccgctgatcggccgtattctgaacggacataccattttggtatacgccgcgcttgtgatcgttgtgctgctgcatctcctgctttatcacacgcaggccggcatcggaatccgcgctgtgggcgaacggcccgcggccgccgcctcggccgggctgtccgtgcggcggtaccgcttcgccagcgttatggccgccggtatgctctgcggcctggccggcgtccacctctcgctcggatatgtcaccctgttctccgaaaacatgaccggcggccgcggctttttcgcttatacggccgtcgtattcgggcaggccgacccgctgatcgttatgatcgccagtttcctcttcggattggccgaaacagtcacctaccgcgcacagcagaccggcctgcccgggccgcttgttctgacagtcccgtatgtggttacgctgatcgcgctgatcgtgcgcagccgccgccgcaaaccagccgccaaatatacaaaggccgcgccggccaaggcccctgcgccgtaaacggcgcggaccggaagggagagatatgatgacaacgccaatcaaaagcatccttgactttgagggaaaaaccgcagtcatcaccggcggctgcgccgggatgggcgcggggcttgccagacgtttcgcccagacgggcgcaaacatcgccgtgacctattttcgcacgccgccggacgggctgatcgcacagctcgaagcggacggcgcgcgctgcatggccgtccggacggacgtgcgcagccccgccggcagcgaggcgatgatccgcgctgtcgccgggcggttcggctcggtcgattttctcatcaacaacgcgggtatctatccccaccacgacctgctggaagtgaccgagcaggagtgggacgacatgcacgacagcaacctcaagggcgcgtttttctgcgcgcgcgccgccgcgcggcagatgatcgcccaggggcgcggcggccggatcgtcaacatcgtttccatcaacgcgttccggcccatgcataacggcctggtgtacggcgcgtccaaggccgggctggccatggtaacgcgctgtatggccgtggagcttggcaaatacgacatccgtgtcaacgcggtcgcgcccggccttatggacgcgccggggcttgatgaaaacgtccccggctggcgcgcccgctacagcagccgcgcgccgctcgggcgcatcgggcggccggaggacatcgcggacgcctgcatcttctattgttcggacctgtccgcctggatcacgggtgaaatcaccatggtcgacggcggcgtgatgcacgcggaagcatacgatacgcagtgaaaggaaggattgaaatggcagacctctatcgccttgacggacgcacggccatcgtgaccggagcaggcggcgggcttgggcttgggatcgcgcgggcgctgggcgagcgcggcgcaggcgtgctcgtgtgcgacatgaacgagcgcctgctcgacggcgccaggcggtccctttcggacgcgggcgtgcgcgccgccgcctgcctgtgcgatgtgacgcgcgagcaggacgtcgcatgtgcgctgcaaacggccgagcgggagctgggccttgcggatattctggtgaacaacgcggggatcaccaggatgcaggatattatggaggtgcgcgaaagcgactgggacgcgatcctcgcggtcaacgtcaaggggctgttttccttcagccagcagtttgcgcgccggcttgcggacaccgggcgcgcgggccatatcgtcaatatcgcgtcaaacggcgcgaaaaccacatacgacgatcaggtccattactgcgcgtccaaggcggcggtcgtcaatatgacccagtgtatggccgccacgctcgcgcggtaccgcatcaacgtcaacgcggtttgccccggcgcggtcgaaacggagatgctcaagggctgcatggcggcaaccgaacagcagacaggcggccgcgtgacagtcggggactgtatgaaaacctgggggccgccgcagcttgggcggctgatccagccggaggaagtcggccggatcgtcgcatttttatgcaccgaggccggggcgatgatccgcgggcaggcgctcaatgtcgacgcgggcaacacaaagttttaaacggagggaacgcagatgaaaaagatcacgtcaatactgacagccctgaccatggcggccgccctgctggcgggatgcggcgcgggcactcccgcacagacgtcctccggcgcggccggggagggcggcgatgccaaaagcgttgtcgtcgtttttccccaggggctcggcgacgccgggccgatggacgccatgaatgaaaaccttaaaaaagcgcaggaggatttcggcatcgaagcgtcgacctttgaggcgctcgaggccgcacagcacgaggaggtgctgcgcacctacgcgcgcgagggcgccgatttgatcatcacctcgatgccggctacggtggaagctgtcaaaaaggtggccgccgaatttcccgatacccgcttctgttcgatcttcccgcttgaggaaatcgatctgccgaacgtgacctgcgtcgatttttccatctgggaagcgtattatctggccggtatcatgggcggctccatgagcgaaacgggcaaggccggccatgtggtcggcgcggaacagtcgtcgctgatcgccaactacaacgccttcaaacagggcgcgcagagcgtcaatccggacatgcaggtgcttttgtcgaacaccaacaccttcgacgacccggccaaaggcaaggacgcgggcatcagcctgatggaccagggctgtgatatcctgatcaccgactgcgccgcgaccggacttggcgtgatcgacgccgccaaggaaaaaggcattttaatgatgggcgactccaacccgcactatgagcttgcgcccgaaaacatcctcgccgatacgctctgcgaatacggcccggcgctctatacgcagatcgaacgctttgtaaacggcgagctggaatccggcacctattattcgtccatccaggaaggcggcgtcgggctgctgatcagcccggaaatccgcggcaacctgccaacggacaagcaggcccgctttgacgaggcgtgtgaaaaaatcgaccaggcgctcgccgacatccaatccggcgatctggtgatcgaacgcaacatcgaaaaatgatcgccctgcggcaagggcaaaacgggcgcggacggcaaaaccgcgtaaaagccaattggacaggcggtgcaattatgagcgaagcatatgaactggagctgcgcgatattacaaaacggttcggggacacgcttgctaacgaccatgtcagcttctgtgtccgccgcggcgaggtgcacgcgctcatcggtgaaaacggcgcgggcaaatcgacccttatgaacatcctctacgggatgctgcgtcccgacgccggcgaaatcctctggcgcaatcagccgctttccctgcgctccccgcgcgatgcgattgcaaagggcatcggcatggtgcatcagcatttcatgctcgccccgtcgctgacggtggccgaaaatatcgcgctcggccatccgcccgtgaaaggccccttctggaagccgaaggagctgcgccggcgcgtggagcttctgcaaaacgactatggcgtcgagctgccgctggacgctcccgtgcgcgacctgacggtggggcttatgcagcgcgtggagatcgtcaagacactctaccgcggcgccgaagtgctcatcctggacgagccgaccgccgtgctgacgccgcaggaatccgtcgagctgttcgcaaccatacggcggctgaccgcggccgggcgcacggtcatcttcatctcgcacaagctgcgcgaggtgctcgatatctccgaccggatcaccgtgctgcgcgccgggaaaaccgtcggcacggctgataaagcgcaggtcaccgccgcgcagctcgcgcagatgatgatcggccggccgctggcggggcttgggcgcggcgagccaaaaaccggcgaggccgcgctcgaagtggacaacctctgcgtcgccggcgaccttggcgcgaccgcggtcgacgcggtgtccttttcggtgcgcgccggcgagatcctgggcgtagccggcgtggagggcaacggccagacggaattgaccgaggcgatcatcggcgtgcgccgcccgctttccggccatatccggctgctcggcgaacgcgccgacggccgcccggtcgacaagcggctgaacgccgggcttgccatcatcccgcaggaccgcgtcagggaagggcttgcgctcagtttctccatcaccgacaatctgattttacatatgcgcggcgcgccgcccatctcgcatcatggcgtgatcgactggaaggccgccggccgcgccggcgcggagatggtccgcggctacgcgatcaaagcgccctcggccgatgaactctgcggcaacctctccggcggcaacatgcagaaagtcgtcgtggcgcgcgagctttcgaaaaagcccaaggtcgtcatcgcctgccagccgacgcgcggcgttgacatcggcgcttccgaatatatccgcaaaatgctgctgaaaatgcgcgacgagggcagcgcggtgctgcttgtctctgcggatctcgacgagattatggaactcagcgaccgcatcatggtgatgtatggcggcaaaaaatcgggagagcttgcaagcgggcaggccaacgaacagattctcggccggatgatgttcggcgagacggtgcgggaaagcgcgggtgatgctgtatgaacatacctctggttaaaaagaaatttctccgctctctgcgcgggctggcaggcgtgcttcttgtaatcgcctgcgcgtttctcatccatatggccatcctgctggccagcgggaaatcgcccgcgcgcatctattccgtcctttttgacggcgcgttcggcggcgtctacaattttgcgcggtccatccgatgggctgtgccgctcatctttaccgcgctttccttcgctgtttcagaacgctgcggcatcttcaacatcggcgccgagggccagctctatatgggcgcgttcgcggccgcctgggccggctttaccttcccggacctgccgcacatcccgctcgtccttctggcgatggccgcggcaatgattgccggaatgctctggtcgatggtcgcggcctggctcacactgaaatttcacgcgagcgtgatcgtcgtgacgctgatgctcaactatatcgcggttctgttcaccgaatacctgacgcgctatccgttttatgtgccgggcacgctcggggaaagcggatcgacgcagtttgtttcggacagcgcgcgtctgacggcgctgatccctggcaccgacgtcacaacaggcgcgctgctcgcgctcgccgcggcggcggccgtcgccttctggagcgcgcgcaccgtcaccgggtacgaatgccgcatcatcggcgcgaacgaacgctttgccgcgttctccgggcttatggtgacgcgccgcaagctgctcgtgtttgcggtcagcggtatgctggcgggcctgggcggtgcggtcgaggtgctcggcaactatgggcgctttatggtcaattttgccaccgggctgggcttcgacggcatcgtcgtatcgctgctcgccggcggaaaccccgctttgatcccggtttccgctctgtttatgggcgcaatgaacagcggttcgatctcagtcgagatgttcggcggggtgccgaaggcaatgaccgatattcttatgggggtaatcgtcatcatcgtaacggtcagggcgattccagtatacgtcaggcggcggcataaaacagcggccgcgcaaaaataaggggccgccgcagccgggctttcgcccaaaaggctttggcccgcaggcggcgcccgccaggaatgtggaaagagggaatgtaaacgtggagcatgtaaaccttcagatttcagaggaagtatccgcggcgctgcgggaaaaccgcccggttgtcgcactcgaaacgaccatcgtttcccacgggatgccgtatccgcagaatgtgcagacagcggcccgggtggaccgcatcatccgcgaaaacggggccgtgccggcgtcaatcggcgcgattgacggccaattcatcatcggcatgacggcaaagcagctcgaccatatgggcaaaaacggggcgtccatccccaaggtttcgcgccgcgatatcgccgcggtctgtatcaagaagctcgacggcgcgaccacaagcgcggccacaagctttctcgcggccagggccggcatccgtgtgttctgcaccggcggcgtgggcggcgtgcaccgcggggcgcagcgcaccatggatatctccgccgaccttgaggagcttgcgcagacgcccgtgatggtcgtctgcgccggggcgaaggcgattttggatcttggcctcacgctggaataccttgagacgaagggcgttcccgtcattggctacaaaacaaaaaagctgccggctttttacacatccgaaagcgatttcgaggttgattaccgcatggacacgccggaagagatcgccgataccttccgcgcgcagctcgacatggggctgcctatggggatgcttgtctgcaatcccatcccgcgcgaatacgaggtgccggccggcgcgatcaaccctgtgatcgaacaggcggtgcgggaggcggaagcgcgcggcattcacgggaaggattccacgccgtttttgcttgcgaaggtcaaggacatcaccggaggcaaaagcctggaagcaaacattcagctcgtttacaacaacgcgaggctcgcggcgcgcattgccgcggcgctctgccggtaaagcgcgcgggccggtctttggacccggcccgcgcctgttcatatggggaggctgtatgatggaacaacggattgaagccgctgtcatcggacataccacgcttgacagcgttgtcacttacggcggggagcttcacctgcgctgtccgggcggcggctgcctgcacgccgccgcaggcgcagcgtactggttttcaaaccatgaaatcggcatcgtgacaaagatcgggccaaatttttcgcaggaaaacgtacaggcaattcaaagctgcccgggcgtcgactgcgccggaatcaggcggatggacaaaaaaggcatggagctttggctgctttatgacgcggacggctatcgccactgggtgctgcatcacgactgctgtacccgcgagcaggccgcgcccgcccccgcggacatccccgcgcgttatcttgaacaggcgcgcggctatcatatcgctccgctgccgctcaaccaggtccgggcgcttttaaacgcgatcccgcgcggccggcatatccagcttgatccgcattacgaatggttcttcccaaaataccgaagcgactgggaacagatcctcccgtatgtgtcggtgcttatgcccagcgaagatgaatttacaaagttctgggacatcccctacggccagccggcgcagcagtacgagccgtacatccgccggctctcggaaatggggcctgaaattgtgattctcaagatgggcgctcagggcgcgctcctttatgagcggaaaacaggcgccgtaacacccataccgtcgcaggcggcgaaaatcgtggacgccaccggcgcgggcgacgccttcggcggcgggttcctcgcgggctggctgaaaacgggcgacgtggcggccgccgcgcaatacggtatgcgttcgtcggcgcgcgctttgcagcttcgcggcgtcatcgctgaatttcgccggcctttttgaaaaaaggtcccccgtttttttgaaaaaaagcctggcgaaaaacttaatcggctgcgttccggcctttttgaaaaaaggcctcggcgaaaaaccttagtcggctgcgccgcgaacagcggggcagatcccagcgtatttgccggctgcgccgcgaacagcggggcggcgcagcgcaaaggcaggctgcgttcatccggtgttcagccgtcgatgcggatgttgacgccgttaacctcgacgccgtcgttggcgcggatcaggatgtatttgcatccattgatgacgcgcgtttcgaccaggtcgctgcgctgcgggttcacatggatggtaacgtcgggcgtgcgcacctcgaactgcttctggtcgacgatgttgcgcggcggcaaatccgtatcggcgccgaacgcgtcgtcataccgcgcgtcaaacgcttctatgttttcctcagaaacgccgcaggactttaaaacgttcttgaccgtgtactttgaaacggccagcggctcgtccacatggttcgccttgtgctcctcgatcatcccgcagagctgttcgtgaaccgtctgcatgacgccaaggctgcaatcgccttcgagcgtatcctccagaagttcctggaacgtctccttctgaacggcggcggccatcggcagcgggcggcggaacaccgcgtccacaaaatcctgattcatctgttcaacgccgcgcgaatagaacagcgcgccgtacaggttcgcgctgcggtcgtcaaatgccgggaacagaaaaccaagctcgggcgcggccacaacccaatccaccctgcagttgcggaatgtgttttcattgacataatagcttaaggcgggctttgtcatcttgaccgggcaaacgctgcaaagaatgtaagaatacacctcggacgccgcatcttcaagctgctgtccgtccttggcgcgatagggaacgtcatatgtatcgtgcgccagcaggatcaggtaatttccgtcaaacgaaaccgcctgtatgacgcgttcataaaattcgcgcgccgcctgttcatcgcaaagcgaggaacttcgcagcgccgtcagcaggcggtgctccgggctgtcaaccacctgctgcgtcgcaaacgcgatatcgatcagatttttcccaagcccgcctgacagcgtccgctttaggatagcgagcagcttttcggcatcctcctgcggcatcagggcgagcggctgtgaaaattcggagacaatctcccgtttttcgttgacataacagccccgcacatgggtgatgttgcttttgtccggtttaaaccggcggcggatttccgcaatttccttttcgttcatacaaacctctttcaaaaatacaattgttttttaaccggcggacacggcccgccgctgcgtcccgcgctaagtttaccataaaccggccgcgttaacaaaccgaaaaaagtcctcctttgacgccttgacagcggccgcacgggcagcttgccgagtcatccggacgcgcaatgggtccgaacggcctgactgcggcggttatattgcctcgataaaatgcacatccgattcatcccaatactttttataaacccggtcctgtttgccgtcaagattcaattgatacatgcggaaaacaacctgtatatttttgggctgccacagctcctcataggaatattgatagcgcatccccagccgtctcataaccgcgccgctgcgcggattgttccggtcgtgcgtagcggtgatatatgccataccatccgctttcacacgctctataaccgccctgcccgcttcagccgcgattgccctgccccaaaattccctgcgcagcccatagcccagatcatgggattcgtccatactcacatttatatatccgatcggcatatcgtcgcttttaaggcaaatagcgtattgataagcccgttcctgccggtagaggccggcataccgccgctgccagaagtctctggcctcatccattgacctgagcgggaaccacggcagatatacgtttgtttctttgtcgctgaaaacagcaaacaacgcgggcagatcgtcccgctcaaaccgtcttaaaatcaaacgctgcgtctcaatctgaggcgtgtttataatatccatccaaggttctccaatcgttccattttacctgtatgtgcgattcaaacaggcgtatatgcgtgcgaattcactttaacatatctgcgccccgttctcaagccctccgccgtctgaaacaggtctgaacgccggcgcatattcaaaccgggacaggccgtccgctgtcccgtccaatgaaacgcgggcatttttgtaagaacacacaaaatttcccggaacgcttgcattggctgtgtccgggctgtatcataattgcatcgccgcgtcccgcgccgcggatttagagcgtggtataaactggcggcgcgggctgttttgccatgctgttttttgtgcggcggcccgctccgcgggcaggcgcatattcgcccggctgaccggggagcttcaaacggcccggccgcgcccgggtccccgccgcacagcccgcggcaaaagacgacggaggagacggacatgggcaagtatattctggcgctcgaccagggcaccaccagctcgcgcgcgatcctgttcgatcatgagcagaatatcgcaggcgtcgcgcagaaagaatttgcgcagctttacccaaggcaggggtgggttgaacacgatcccatggagatttacgcctcgcagtacgccgtgatgatggaggtcatcgcccagacgggcgtgaacgcgcgcgatatctccgccatcggcgtcaccaaccagcgtgaaaccacgattctttgggaccggcggacaggccgcccgatgcataacgcgattgtctggcagtgccggcgcacagccggtatcatcgacgcattaaaggaacagggcctgtccggttacatccgggagacgacgggtctggttccggacgcttacttttccgggaccaagatcaaatggattctggatcagacgccgggcgcgcgcgaacgcgcgcgcaggggcgaaattctgttcggtacggtggatagctggctggtctggaaactgaccggcggcgcggcgcatgtgaccgattatacaaacgcctcgcgcacaatgatctataatatcaacacgctcgattgggacgatcgcctgctggacgcgctcgacatcccccgcgcaatgctgcccgccgtctgcgacagcagccgtatctatgggtatgcagaaatccagggggcgcgcattccgattgcgggcattgccggcgatcagcaggcggcgctgtttgggcaatgctgctttaagcagggggaagcgaaaaacacctatgggaccggctgctttttgctgatgaacaccggcgaaacgccctgtatcagcgataacggcctggtcacaacaatcgcggccgggctgggcggccgggtgcagtacgcgctggaggggagcgttttcgccggcggggcggtcatccaatggcttcgcgacgaaatgcgttttctcaccgaagcgcgcgacgccgaatattacgcgcaaaaggtggaggataccggcggcgtctatctggtgcccgcgtttacagggcttggcgcgccctattgggacatgtacgcgcgcggctgcctggtcggattgacgcgcggcacgcggcgcgagcatatcatccgcgccgcgcaggagtcgatcgcttatcagagcgccgacctggtgcgcgcgatggagcgggataccggcgtcccgctggctgaactgaaggtggacggcggcgcctcgcgcgaccggtttctgatgcagtttcaggcggatatcctcgataaacgcatccgccgccccgttatccgtgaaacgaccgcgctcggcgcggcgtacctggccgggctggcggtgggcgtctggagcagccgggaggaaatccgcgggctgtggagctgcgacgccgccttcacgccggatatggacccggcccggcgcggcagcctgctgcgcggctggcataaggcggtcgggcgcagtctcgactgggaagaacatacataaaagccgaaaggcccggctgtcttaaaaagacagccgggccttgtaatgttttatggcggcgggcggcgcttcaatccgactcgtcgcggcggcgctcaacctgccgcagcacctctgcggcgtcgcgcttttccagcgcgccgacaagcgcctgcaaaatgcgcagagacgcttcgttgcgcgccgcgtcgctggcggaacggcgccgaatgattttcagatagtcaccgtatgtctgcaaaatcgcggtaatcctgtttaatccgctgatttcgtaggcgtagctgtaaaaatcgtcgacctcctccattgcatcctccagcatatcggtgctcaaaaacgcggctacgcgccgcacgattttgcttagatgcgcaacctgctcctgcgacgccttttcagccagccgcgcaaagacaacccgctccagggcgatgcgcagctcgatgatttcgccgaacgcttcctcgtccagccctcttgcggcaaagccgcactggggaatatggcgcgccagctgctcctgttccagcaggcgcagcgcgcttttgatatgcaggcggctggcctgatagctggctgccagcgccgtttccaccagccgttcgccgtcatggatctgcccttgcaggatcttccggcgcagatcgcgatagatcaaatattccggaccactgttggacatcgtgccgccccctcagaatgatatcaatccatatataaaatatcaaagcgaaaaatttttgtcaatcttccaatatgggttcaattttacgaaaatcgcttttttgcttaattaattgttgtataatcttataattgatatcaattttaaaatatgatatcattattgcatcacacgttttattacacgcaaggaggacacgttatgtttttttataaaagattgctgccgctgtttgccgccgcactcctctcaggctgcggcgcggcggcgtcccccgcgccagacgcggcgcagcccgcggcctggaatgaacaggcgcttatggacacctgcgccgccgcgcttgaggcgatccgtgcctcggactttgacgcgttctatgccagggccgcctctctggagcaatccctgccgccgcaaaagctgtcagagcaatgggccgcgctttccgccagcgcgcgcgcttacagcggaacacagacaatggagacaaaaacgaccgaatcaggcgcgcaggtacaggttacgtcgatccatgcgcggtacaatattctttccaccttcagcttttccgacagcgggacgatcaccgcgctgtccatgcggctcgcaccgctgacagttgcgcccgcttccggccggatgtgggaggaatttcccatcacgctcggttatgacccccaaaagcagcttaacggaatgctgaccctgccgcgaaacgtcgagaaaccgccggtcgctattctggttgcaggctccggcccgcaggggatggactcactgatcggagcggcgaataaccggccgatggcggatctcgcacagggccttgcggagcatggcattgcgtcgatccgctatgataagcgctcctacgcatatccggaggacgtcgttgatatacagacggaataccttttcgattttaaggatgcggtccgcttcgcgctggaggacccgcgcgttgacggcggccgtctttatctgatcggacacagccagggcggtatgctttccccgaaacttgcacaggacaatccgcaggttcggggagtggtgtcgctcggcgggacgctgcgccgcatagaagatctcatcttggaacaaacggtaacgcgtctgtcacaggatacgacacagacagacgaacaaaaaaatgcgcagatagcaaaaacccaggcggaacttcaacgggtgcgcgggctgacggaggacagcgccgctgaccgcacggaaattctgcttggttatcctgcaagctattggatcagcctgaacgccatcgatcaggctgctatcgcccgggatttggcgctgcccatgctgattatgcagggcgacaacgatttccaggtgctctatgaaaaggattttatgttttggcagcaggtcctggccggacgggaagatgtcacattccgtcattacgccggcctgagccacgtctttatgccgggcagccgcgaccggtttgacagctcatcctatgatccgcccgctaagatggaccggcaggtcatttcggatatagccggctggattctcagccaaccgtaagccgcaggccggaaggacgcatacaatacctggacatcccctgcaaaagcgcgcaaagccttgccatacaggcgcagatatgatagaataatcgatggaacaaatacatatgtgcgccgatcgcgtacatttaaaggggattttcttatggattatatcagcacgcgcggcggcggccggccggtttcggcggcgcaggcgatcgtgtcgggccttgcgccggacggcgggctttacgtcccgcagtcgctgccttcgttttccctcgatgaaattgcgtcgcttgccaggcttggttatgcggggcgcgccgtcgaggtgctctcccgctttttaacggactttacgcgcggcgagctgacggaatatgttggacgcgcctatgcaaaaagcaagtttttgcccgaggctgtcgcgcctgtcgtgccgcttggcggcgacggcgcgtatatccttgagctgtttcacgggccgacctgcgcctttaaggatttcgcgctccagcttctgccgcttctgctgacggcttccctgaaaaagacgggcgtggacaaaacggtcgtcattctcgtggcgacctccggcgatacaggcaaagcggcgcttgaaggcttcgccggtgtgccgggtacaaaaatctgcgtattctatcccgacggcggcacaagcagcatccagcgccgccagatgacgacgcaggccggcgataacgtgatggtgttcgctgcaaaaggcaattttgacgacgcgcaaaacggcgtcaagcgcatttttaccgacgcggccttcgccaaggctctctctgagcatgggtatctgctctcgtcggccaattcgatcaactggggccgcctggtcccacagattgtctattacttttccgcctactgcgagctgctgaacgcaggacgcatcaaggctggcgatgcgatcgatgtcgccgtgcctaccggcaatttcgggaacatccttgccgcgtggttcgccaagcacagcggcctgcccatccggcgtttaatctgcgcgtcgaaccgcaacaatgtgctgaccgacttcatcaaaaccgggacgtatgaccgcaaccgcgatttcttcctcacgacctcgccgtcgatggatatcctgatctcctcaaatctcgagcgcctgctctatctgctctgcgggcgcgacgacggccgggtgcgcggctatatgcagtcgctcgcagaaaccggctcctacacggttgaacaagatgtgcttgcccgcttgcaggcggaattttcagcgggctgcgccgacgacgcgcagacggcgcagacgatccgcggcgtctgggaaaagacgggttatctgtgcgatacgcatacggccgtggccgtgcgtgtctgcgaacaggcgcgcggcggcgacaaaacgccggttgtgatcgcctcgaccgccagccccttcaagtttgccgccagcgtcctgcccgccgccttcggcgtcgcgccgcagggcgacgatttcgcgcagcttaacaccctttccaaagcgtccggcctgagcgcgcccgacgcgctggccggattgcagggccggaaggaacgttttttgactgtcgtcgcgcccgccgatatgaagcaggccgtctccggctggctctcgcttttttgaaaaatagcttggcgaaaaactttccggcctttttgaaaaaaggcctcagcgaaaaactttagccggctgtgccgcaaacagtggggcaggtcccggtatttttacaggctgcgccgcaaacagtggggcaggtcccggcatttttacaggctgtgccgcgaacagcggggcaggtcccggtatttttacaggctgtgccgcgaacagcagggcgggcgctgcgcataaacaggctgtaccagccccggaattggttccatgggatgggggcccgtcctgtcccgtgaggcgcgaaaaggggcgccggcgcggctggcggggctttcagaagcgccggctttcccggctttgccgaacaggcgttatgccggcgcaagctgtatatcccccagataagccggactatttttaatgaatcatcaggagaagcatatgaaatatattgtcatgcttggggacggtatggccgaccggccggtccccgcgctcggcggcaaaacgccgctggaggctgcatatactcccaatatggattttttggcgcaaaacggcgtgacgggtatggtacgcaccgtgcccgaaggaatgccgccaggctccgacacagcaaacctttccgttatgggctatgatcccaaggtctattacagcggccgttcgccgctggaagcggtgagtatgggcgtggagcttgcgccggacgacgtggcttaccgctgcaatcttgtaacgcttacggatatgccggcgctcgaggacgctgaaatgatcgattattcagcgggagaaatttcgaccgccgaagctgccgagctgatcgcctgccttgacgcggcgtttcatacggacgactgcgcgctttatgccggcatcagttatcgccattgccttgtgctgcgcgggacgcggacaggaagcgactgtacgccgccgcatgatctttccggccagccggtccgcggacatctgccttccggccgccatggcgcgcgcctgcgcgaaatgatggaacgctcgcgcgcgctgctgcacgatcacccggtcaatcaggcgcgcatcgcgcgcgggctgcgtccggcgaatgcctgctggttctggggagagggaacacggcccgcgctgacgccgtttgagcagctctatggcgtgcgcggcggcgtgatttcagccgtcgatctgatcaagggaattgcgatctgcgcagggcttgacagtatcgatgtaccgggcgcgaccggcaatatcgacacaaacttcgccggcaaggggcgggccgcgctggagctgctgcaaaacggtcacgactttgtttatatccatgtggaggcccccgacgaatgcgggcatcgcggcgaagcggaaaataaagtcgcttcgatcgagctgatcgaccgtgaaatccttgggtgcgtcttgcccgccctgcgcggaagcggcgaagccttttccgtacttttgatgccggaccatccgacgccgctgtccatccgcacacacacagccgatccggtgcccttcgcgctttaccgcagcgacgccgtgccggacgcacattggcgcgcgcctgcctataccgaagcgcatgccgcttccaccggactgatgatccccgcgggacatcgcatgatggaatggcttctgcgcggtcaaatgcccgaaaattttgccaaaagctgttgacaagcagccgatcggatggtatactaattaagcgtgatcacactgatgacgtgcaattgcgggtatggcggaattggcagacgcgttagattcaggttctaatggtcgcaaggctgtgcaggttcaagtcctgttacccgcaccaaaaagaatccccactttggataccatcggcagaaatgccgatggtatcgggcttttcagggggtttttttcacctcgactttcacaggtaaaacaaaagatccaaacagggattttatacaagctgactggattcggacttccgatttcctggaaatctatagcgccctttttgaaatgagatttttcaaaaagggcgttattttcatatcccgaaaaagagcgctaaagttacaaaggagggagaataattgttgtaccgatgacagacgccagcggttgctggaggatgtccgccgccagatcgagcgtagtgttccaaatctacaggagttgatgagccaatttaatcaaaacgaaattaacatgagcatgtaagcgccggggctttagggataagagtccagcacttttttgcgtttggatgaggtaatcgaaatgaatacagagcaaaacaatcccacatcccataccggcaagactgtcgggcggactggtatgctcccaatttggcctgtttggagggcgggcggcggcttggagatgcggcacaggggtatcaggtggaagtccagactctgcgcggctgaataaaaaagtgcgatgagatggggcccggcgggactggagatcgacggcgctctggtggagcttcctgccgttccggaagatgacgccgttgacgatctgatggctacgcatagcgtgagcctcctggggcgtcaggtcatcatcctccgggaaggcctggacgaagtggtattactgccgtccgtccgttttccggaatcgctccttggtgagcggcatctcggagagggagggctgagcggtgcagttccagccagtcaccagccgttgtccttcccacagcgtttttcgtcttacttggtgtaccgcaacccctccctggcaccacggcctccgccccggttcttgacgacggtgaaggtggccatcttaggacacctcccgcaggagctggccgagctgctcactgatctgtctgtatccctccgtcagcttgtctccgtacaccatggtgacctctcccatgtttgccaaggcggcgagctggttcaggttccgtccctgagccttcagttcggacagcaccttgtccagcccgcacaggcacaggtagtcggtgacaatcaagcttatctcctgtgccttggcccggatgcggtctttggtgtggggcgtcacccgtagggtgatgatcttcgttttcttttccttctgcattgatactcctgcctacgtcgtttccttcagaaactggggttcggggcggcgccccaaaccagtggccggcgtatagccggacgcgatgcttatcacccggttctggggcgtcacaggcgggaaggtgtccctaggcgggaccagatgtatccacggtggatccagagactctcctgcgctcctacttcatggtattccaggacacggtaatggaaaacatccgcctgggtcgccgaggcgccaccgacggggaagtgctggaagccgtcaaggccgcccaatgcgacgagttcatctgcaagctgtcccagggctaccagacagtgatcggcgagaatggttccactctctcctgtggacccgtcacagactacatggacacagtcagagcggttctcctttggcctactggagctggcaaagcgctgcggctggtaaaacagcgaaccgttcgtgatttcacatcgttgtagtttcctgacatctcttgctgtgatataaaagtgtctgaaattacatagaccaatcattgcatgccaaaacaccatcatggatccattatcttgcaaacgaagttatcgtttgcagaacagatgctcctccatcgctgggcctgcatacaggcccagcgatggaggagcaaatactcttatatgggcaattcctgattcaaaaatcagaacaaatctttatactcgccaatgttttccttggtaaaccgaatggggtctcccagtaatacttgtgtgccgccatcgtagtactcctctacagtatactctccaaggcggcctgccgtcaccgtatcgcccacagcgcctgtgctttcccctgtactgatggagttgacagaagcagcagccaaatacccctgatcgtagggattccaaagatagcaatcataacaaatgccgctttcaatatagggagccatctcagaaggcagccctacaccggtaaccttacattccgaacccaaatcctgaatgaccttcgcggcagacagaatgccaacagtggtgggactaatgatgacatcaatgtcaggataattctggagcatggcctgcgcttcagtggtagacttgtccggcagatcatcgccgtaggcaatgggcagcaccgtaacattggcaaagtcctcaggattgtcttccacttctttcagcatggcgttgcaccaatcagcatgaagctgggactcaggctgcgccgacaaaataccgacggtcccttctgcgccgggtcctccaataatctccaaagccgacttcatctgatcacggcctaccaggtctatggaagcctgctcaacatgcagctgccgggaatccgggttagcggcagagtcaaatgtcactacagcaattccctgccccatggcttgagtcagcaccggttccagcgcatcaaagtccgcagcgattactgcaaggccatccacaccttgcgccatcagctgtgtaataatctcaatttctttttcggccgtaggttcatctgaaccacggtacatacagtttgcaccaatgctctcacagaactcccggaagccaatatacatatcaatgaacactgggtccgaaagcgttttggacaccatcacataggtgggagcatcttcactgacctgtaaatccgctgtcggatcatcgttggtctctgtcggttcttcgctggcttccgcatcaccggtatccggctgggtcgttccagcctctgttgatgtattgctaccggtgccggccgcagtggtatccgatccgctgctgcatcctaccatggaagtaaacagcatgcacagagcaagggtaagtgctaagatctttttcattatcaggttcctcctttttttattacaagctgacgtttgcctcgtctggattcctttgcatccgccaacacttgtttcatattgggagctgcacaaaccacgatcaaaagaataccgataataaccttcagcgtttccgcagatacattgaccaaccctgtaccatatcggatcagaccgatggtaaacacgccaacgatcacaccacctacacggccctttccgccggatgggctggcgcctcccagaatcgccatagcaataacttccatctcatatccctgggcaatgctggcgcgaaccgaggcaagcttggctgccaggaacaggcccgcaaaagacgcgcacaggccactgatggtaaataccataattttaatgcgcgatgtgcgaatgcctgaaaaatagctggcagtgtaattggatcccaacgcgtaaagacggcggccaaatgccattcgatggatgacaaacataaaaatcacagacaggataataaacgccaccagaatcacaggcagaccgaatattcgttcccaagccaaatccgacaattgtttcgcataggtcttcagcgattcatcctccagcagcatatacgccagaccacgatataggatttgtgtgcccagtgtcacgatggtggagttcaattccggaaacgccgccagcagaacgccgttgaacgcgccgcacagtgcgccgaccagcaaagcaaccaaaacgcatcccgccagcggcacccccagttcgccggcccatcctgctgtgcaggcggataacgtaataatggatgcaatggaaatatcaatctcacccaatatcagcaccatcatgatgccgaataccatcaatcctttatccatgaagttgatcatggaattcatcaaattaatatagttcaaataatagggagagaggttaatattgatgatattcaccagaagaaagatcagtaccagcagcgtctcccactgagcaaacagccacccggtcttttgacgcaacgtgttttcctgctttcgctcacgctgtctcatcaatttctctcctttccattgctcttttagctgctctgcgggctaccaacgagttgataatcaccgccagcagaattaccgcaccgcgaatggctctctgccagaaagaagaaacctgaatcaatggcagaatattattaaggatgccgaacagcagcgaaccaagtaccacgccaaaaatcgtacctgcgccgcccttgatgctgacacctcccaaaaccacagaagcaatgacgttaagctcatagcctgttgccgtagtaccctgtgcattggcatatttgcaaacccacagcacacccgctaaaccagcaagaacaccgctgaatatatacgaaatccactttacctttaccgtattgataccagaaattttcgcacagtgttcgctgtttcccaccgcataaatgtgccgccccagccgggtatgccccatgagaatcgttccgaatatcactgcgccggcagcaaaccataccatgcagttgatgccaagcaatttgtctgtagcaatggacagaaagcccggcgtcatgtcggactgcccgacccattcgccattgctgaaccaataaatcacaccacgcagaatatcacatgtacccaacgtaccgatcagtggaaatatgcgcagctccgccacaacaaagccggtaatgacgccgcagatcagccccacgcccatggctaccagaaagaccgcaatcaccggcatttgcggattggcccgcagcgtcagggctgcgatcattccggacagacccattacggaacccaccgacaagtcaataccgccgcccacaatgacaatcatcattcccacggaaacaattatcagcatggatgcctcgcgcatcatctcattaagattggatgccgtcaggaaactgcctcccgtgcgcagctgtacgagaatacttacgatcagaatgacgcccagcaaggccgcctgctgtgtgcgctcatgcaaaaagcgtcggatgcgtccggacgccagttttgtttccatacttgccgcacctccttaatccttcagcatggtgtctgccgagttcatagcatacgccagcatcttttcctgcgtcgcctcttttcggtccaggatttttaccaggctgccctcgtgcatcacaccaatgcggtcgctcatcgccagaacctccggcatttccgaggagatcaggataatcgcatatccctgctctgccagatccgacataatgctgtatatctgagattttgcacccacatccacacctttggtcggctcatcaagaatcagtacgttcagatccagattcaacagcttggcaaatacgaccttctgctggttgccgccggacaaggcgctgaccttctcatcaatgtccttggtccggatggagagctttttccggaacgcttctccgtcctggcgctcctgtttgctattcaatcccgccgctgtactgtattttctcagtgacggcaaggtaatattgcggaaaatagaccaatccagcaccaacccctgaacctgacggtcttcaggaaggtaacccagcttcttctgcattgattgcagcggatgggtaaaccggacggtttctccattcaggattaccgttccgctctcgtaggttgtcacgccgcagatggcctggcagagttccgaccgtccagcccccaccaggccggtcaggccaaaaatctcgccgcggcggacggaaaaggaaacatttctaaagttgcccgtttggcacagattcttcacttccaggattgtttcccctataggcacctttttcttgggatagagatctgtaatcgtccgtccaaccatagcctgcaccagcagctcattggtcaactcccgcagctcccaggtaccaatgtacatcgcatcccggaataccgttacccggtctgccagacgatacatatcctccaaccggtgcgaaataaagattatggattttccctcattgcgcagctgctctgtaatccgatacagctcttcacattcccgcttggacagggctgctgttggctcgtccataatgactatttccgcgttggcggcaaccgccttggatatctccacaatttgctgctccgccacgctgagttcacccatccgccggtgcgggtcaatgcctgaccccaggctccgcagcaattctcctgcacgaatgtgcattcgcttccaatccaccaggcccagcttgttccgccgctcatgtcccacaaagatgttctccgtaacgctcagatgagggtacactgtgctgtgctgataaatggccgcaatgcttttcgctgcagagtcatttgtgttctgaaagaccaccggctgcccttttaccaggatttctccttcatctggcttatgtacaccggtaatcaccttgatcagagtacttttacccgcgccgttttcacccatgagcgcatgtacttctccgggcttcagctggaactgtacattattcagcgccaccacacccggaaatcgtttcacaatatttcttagctccagaacatactcgctcatatactcacccttgaccttccggatctaatcggttactgtactgccgcagcagcctggcggcattggccagcatcagttcgggatctctgtagttttcggaatagagctctaccgtcacatagccgtcaaaccgatattgtgtaatcagactcaaaatatcctccaccggcagttctcccacatccagccgggtatgtgcgtccgttctgccgtcgttattgcacaggtggatatactgcatacgtccgcgcagcttggtaaagtaggacgataaaggttcgtgggcaatccggggcggcaccacgtccagcatggcttccaccgtgtcaagcccgatctcttccagagcgtccgcacagtcatctgcggtcgtaatgactggactctccatgggcgtcagcggctctatcaccaggcggacaccgcgctgcgctccatagcttccaagtatatgcagattttctacaaattgcctccaggcagctcgccgccggaccgtatatcctggatgatccgccacaaccagcatcctcggaatctccatggctgcgcagccgtctatcgctttgcgaaaatatgccaaggtgtcctgtctttcctgctgattttctgcacagagattataaggcattccaatgctgaccggcgtatacatgggggtctcaacgccatatacgcttttccagcgtcgcacctgcgctgccagctccgatgtgacatcctgtggataggcgtgcggccttcctccccagatttccaagccgtcaaatccatacttctgtgccgcagcaaaggcgtgttccaacggaaatcttctaaaatccagcgaaaaacatccaaatttcacttttttccctcctctgcctgcattgccttcaactgcttcatgatcgatgtctctgttccgaacgcatcatggagttgacagtatagttcatatagccggtcgtacatcctgcctcggtccggagtcggataataaacacgggatacgccgccgcccatggctgctgctgccagttccatattcggaaagccgcttcctgccaatgcaccgtaaatgcagctgccgttacagctgccgttggcctcgtcggaaacctccaccggcattttcaacacatcggcaaacacctgcatcagaacgggattcttttccgccacacctcctgtaacccgcatacgtgccacaggaataccatagttttgaaattgttctacaattcgacgttttccaaaggccaaagactgcatcagcgcttgatatacatcttcacatgtggtgttcatcgtcataccaaccaacagaccgctcaaatccgtatccaaaagaacggtgcggtttccgcaccaccagtccaaagccagcaagccgctggcagccggctgccgcgctgcaatccggtggttgagaaaatcaaaaaccgtttctccacgcacttttgcagcatcttcaatctccttcggcacccactgctctgaaaaccatcggaacagatctcccatggtagcctgtcccgcctcatagccgtagtaacctgggatcatactgtcactgctgattccatacataccgggaatggcaattcgttctgaatggatgaccatatcacaactggaggttcccatcacactgagcagtacccccggctgatacaatccgacgcccaaaaaagccgcctgacaatcccccaatcctgcggccaccggaattcctgccggcagccccaactgtgccgcccgctccggaagcaggccgccgatggagcgtcccactgctaccagcggtccgcgcaatttgtccagcgcagacccgaaccccggcgctaccgcctctaaatagtcaaaggaagggtattcagccgtcgggtcccatagagcagcacatcctgctatgctgcggctgcggcggcgttctcctgtcaaataccagggtatccagtctgccagctctacaaatgcatctgccgcctggtagagttccggcgcccgctcgaatgtctccaatattttgggaaacatactctccgcatagacgctccctccgcaataggccagaaacatctctccgcgctgctgtgcagcctgcgtcatacggtcagcctgcggctgtgcgctatggtgtctccacagtttagcgtaggccatggggtgattggcaaactgttccgtttgacacagaggcgcgccatcttctcccacgggcatcatggtgcattgtgtaaaatcgatccccacgcccaccacgcgattgggatctccagattggagcagcgcgggaatcagggcgtgcagcgcgtctatgtagtcctgtggatgctgcaacgcatcccccggccgcagcgttgttccatccggaagctggtcgctcataacaccgtggggataggaaaacacagcttctccaagcagttttccatccagaccgcggagctgcgcccgcgcttcccgcgttccgaaatccagtccaatagcggtatatccgccgtaggatgataccctgtttttcatttgcgcctcactgtccgtaggtctgccatccggctttttcctgagcgatcagcgccggatccagctgtgggatacggcatcccatagcccgggccagcacataggttttagccgcctcctccagatagattgcggaaaacagcgcctcatccagattggcgccgtacgccagcacgccgtggtgctttaaaatgaccgccagagcatctccagcatattccgcagccagaacccccatgccaatggcagaggacggcgtaaacggggccaccttgaccggcgcatggcaggcatctatgactgtgaccaaaaactccggcagttcgtccgtatcaaagccggctgccgtagcccatggctggtgagtatgaataattgcatggatgtttggcatgtgatcaaacatgtacagcaacgcactggcgtctgaggacggtttgcgtgtgccctctaccaaacgcccctggccgtcaatgacacaaacatcctccggcgtcatattctcatagagcatacctgatggtgtgaccaaataccggtcctccctcacacgcatgctgacattgccgccggacagggagaccagaccattttttttgatttccaatgccgcctggagcactttagccttttccgcttcccacatgctgtttcctcactttctcaatgcactgttccatataggttctggcctgaatgattcgctcccgatcatccgacgcctccgtattccacatctccaccaccaaagggccgcagaacttcatatccgccaactgccgaaaaacgccctcaaaatcaagacagccggttccaaatggaatggtggcatcataacagtccattatcgaatcacgcatatggactgccacaatgtgtcctgcgccatagggcagctcccgaattgggtcgattcccagcgaattgatattggcgacatccggatacagctgcagccagcaggaattgatggcgcgaattacctgcattgtatcgcggacggccagcaaattgccctccaccggctcaatcgccaaggtcacacatgctttttccgccatctgcacacattgaaacagattctctacatatcgtttctgtgtctcagccgtccgcggctcctgatcgtatacatcaaatcctgaaagctgaatcacccgaatccccaggtctccgcacaaggcaatggctttttccgtcatttccagccctttgtgcaccagctccaaatttgaactccccagagggtaccgttttccgccactcaagcaggtcgtgagaagcttgatgccgctattggatgccgcattgcgtacagcctgacgttctgcagcattccaatccagtctggccatccgttgatcggtgctgtccaagctcagctcaaaggtctcgtagccgcaggatgccgctgtatcaaatagcttctcaaggcttctcagcctcagcgccttttcatatacgccaaaaaccggcttattgttcaccatatctctgtaacctttccatcaacacgccgtattgttcttgtgggtccggtgcattccaaatagtcctgcccatcacaatcacatttgcaccgcatgcggctaccgccgccatctgttcctcaccgattccgccatccgccataatctccatttccggaccatagagcgtccttgctcgggatatcttttgcaggatatgctcattgaaccgttgtcccattccatccggttccgatgtcataatcaggagatagtctatccattcccgatacgccaggcctgcttcaatgggcgccatacagttaaaggccaggccagctcgcccaccgccctttcgaattgcttggagctgcaccgcaggatactgccccgcttcaatatgtatcgcaatcgaatgtacacccatttgcaacagatccaatacatagttttccggttggcttaccatcagatgagcatccagcctctgcttggcataccttgccactgcccgaaccgtttttaaaccaaatgtaatgttgggcacaaagttgccatcctcaatgtcaagatggagactaggtgcattcttcagggtgtcaatgtgagtctgtaagtttaattgatctgcagacgccaatgacggttcaattaaaatcattataaatcaacatcgctctctgtttcatctgatttatgttacaataataccattatttgattttatttgcaattattttttaaaaatatagggtacaatttgagtagataatctttgtgcaatttgaccagctcaattatttgatgttttatgatttatttattgcataatttgatttattatgttacaatacagttgtgcaaatgggtatatacatacaaaacccatcaattataatcataatattgaaaggatgcggattttaatgaactggatggaagagttgttcggagtcaaaaagcccattatcgccatgtgccaccttcagcccttgccgggagatcctcattataataaagaaaaaggaatggattacgtattggagtgcgcacgccgtgatcttcatgctctgcaaaacggcggtgtggacggcattatgttctccaatgaattcagccttccctacctgacaaaagtagagcccatcaccattgccgccatgggctgggtaatcggctcgctgcacgaggaaatccgtgttccctacggcgtcaactgcctgtgggaccccatcgcttctctggacctgtgcgttgctgtgggcggcaaattcatccgtgaaattatcagcggtgtctacgcctccgactttggcctgtggaacaccaatgtcggtcagaccgttcgccatcaaatggccattggcggcgagcagatcaaactgctgttcaacatcgttcccgaagccgcccaatatctggctgatcgtcccattgaggagatcgcccgctctacggaattcaacaaccgccctgacgccatttgtgtttccggtctgactgccggcagcgaaaccgatacgcaggttctttcccgcgtcaaggcatctgtcaagcatactcccattctctgtaacaccggctgcaacaaagacaatatcgttcgtcagctgactcattccgacggcgctgtatgcgctaccaccttcaaatacgatggtgtatttgaaaatgcggtagacgaatcccgcgtccgtgagtttatggatattgtaaaggagttccgcaaaacattgtaatattctgcacagcagacgatctttttttgtgaggcggatgcaagttgcgggctgaggcgaacgtattgtgcattatcctcagcccgcttatcgtattgttttgaacagttcagtttcttttattgccaaattgcatcacagctgatataatctaagtaaaatgatcctaagtatctgctgctgcaattcaccaacagtaaggagaattgctttgaatacagattattttatgggaatcgataacggaggttccgctaccaagtgcattctttgcgaccgcagcggccatattatagcctcggcctccacccgtatcccaatgcagcgcggcagtcacggtgaaacagaacggcccgcagaacatatttgggaaggaaactgtcgggtgattcgttccgtattggaatccgccgccatagctccagcccggattgcctgtgtcagcttttgcggttatggcggcgggcttaccgtgttggatcatcagtacgcgccggttattcccagcatcgtatctaccgatacccgtgccaatgatctgctgcagctttatgatcaaaacgggacggcacagcagatctttcaatatacccaccagcagctttgggccggtcaggctgctgtattgctcccctggtggaagcggcacgatccgcacacatactccaattttacccatgtactctccatcaaggactatattcggttttgcatgaccgggagattgtctactgaggccaccgatgcctccaataccaatctctttgatttgcagcgccgccagtttcatcctgattgctttgcggctctggacataccggaggcgcatagctttttttcctaccctgtggaaggttcagctgaactgtgcggcaccgtctcccaagaagccgcagtctgcacgggactgttggccggaacgcctgtagccactggattatacgacgccgcctcgtgttgtctggcagctggtgttctggatgaaagccggctgtgtcttgtcatgggaacttggtcaatctgctgccgccttatcccgtctgagcagtccattcccggcaccagtaccgcgctttgctctttccgcccggatatgacattttgggaagaagccagcccgacctctgccagcaatctcgactggtttttggatcagcttctttccggcaaagacctctgcggcagctctgcctatgattattgcaatcagatggtagcagacgtggatcctgcatccagtgatttgatttttttaccttatctgtacagttccaataccgtttctggtgcaaaagcatgttttttcaatctttccagtcaccatacgctgcgtcacatgcttgcagcggtatacgagggcatcgtattctccatgatggatcatgtacacagactttgccctcactcgcttcctccgactgcccgcctgtccggcggccccgcacgttcggccatctggtctcagatgttgtgcgatcttctgggtattcctctggagattttggaatccacagaaacaggcgctctgggcagcgccatgtgcgccgccgccgctgtcggcgcatactcggatctgccaactgccgccaaatccatgaaccacatccaaaaacggtatattccaaacgccgttcgccatcttatttaccaaaataagtatcgtctatatcagcgagctgtggaagctttgaaagtattctaccgctgactatgaagccgaggtgatttatcatcatgctgcgtgctgaacgctaccagcaaattgttgattttgtaaataaaaaagggatcgttgcattggaagatcttatggaggaagtccgtatttcaaaggctacagccaggagagatatcaacgatctgtcagcgcagaatttgctgattaaaattcgtggcggagcaaaatcgtgtaatgtggaggctacctcagcagagccatcctttgtggccaaaagcctggtcaactctgaagaaaagcaacggattgctttagctgcactggagtatattcatgacggtgacaagcttatgttggattccggaacaaccgttctggagctggccaaacttctcaaatcaaaatcccatttgacggttgtcaccaatgatatccgcatcgcagctgaactccaggatattcccgatctatcccttctgctgatcggcggcatgatacggaagggcttctgctcctcctatggattttttgcagaaaccatgcttggcaatattacagtcagcaagctctttttctctgtggacgccatcgatccggagatgggtctgaagagctataccatggatgatctcaatattaaaaaaatcggcatcgccaatgcatcagagcgcattctcctttgcgaccattccaagttccagtcccgcgccatgttttctattgctggcctggatgccattgatacaattattgtcggtaacgagttggaagaatctattgcgcagaagctgtcccatatgggaaagaagcttctgttggtatgagcttcctgcgttatgatgagggtgcttgaagccgacattgtccgtaccattttccgtctttacaacgaggagggctggggctacaagaagatcgccaactatctcaccgaacaaggcatctctacaccccgcatggccgagcgcggccggaaggaagccgccggggccgaataccggcgcaccgtcaaatctgtgtgggccatcgtcacggtacagggcatcaagaagtatgacaatgtgtactccggctttctcacctgcagcgactgcggcgcacccatgttcgccatgagccgcagcgatcagaaaccggcctacacctgcggcacctaccaccgctgtgacagggcaggctgtacctcccactacatccgggtggacaagctggatgatctgctaaagctttacatccggcgggttatggatcattgaggaccgtctggaaattcggctacaggccaacgtggacgccatcttgcagtccgccgtacaggaggacgccgtaaattttaaatccggcatcgaaaatattgagtccttcccggcgcagcggacaccgaaattaagaaaaaccttgaatgaaacacagtaatttttaaagatactcgctcaggctgcatgagatgctgtagcgcagcttcatattgcacgggagagagccagccgagcgtagaatgcggacggatcgtgttataaaatgcttccatataaacaaagacctcggtttgagcagcctggcgggccgggtattgcttgagatgaatcagttcgcacttcaagcagctgaaaaaattctcagtgacagcattgtcgtaaggatcacctttgcgggacatgctctgccggatactgtaagccttcaaacgttcccgataggctttggcggcatactggacgccacggtcaagtaatatggagcggtactttccatttgggaaagtaccgctccatatttgtttttccgatatatccgctccctgttcacaaaacgggctaaatggatttttctatttttaaggtttaatcactaatataaacaatcttttcacttgttcttcggattattttcccactcggaaactttataaaatatgaaatccggtatactttatttttatccacctcaaatgtgcacatattctgcgggctgtaccaaataatttctttgcgctcattgccttcgaataaataaaatgcatatagcaaatccatctcagatactgtatttaatctaaatattaattttccatttgtataatcgcattcatagcctttcaactcaaatgttaatttgggaataattgaatcgcaaatcacctctttaaaaaaccaagttctgtcattcgtgggataaacagcagttaacttaaactctattgcctctgcctccaaatttataggagaaaaagtatattttccgcgctttgtaattttctgtatatcatcaagactggattgtatttcatatctccaaaaccatcttccccactggggtttgattctaatatttccctcaagatcctctataaccgtcgggacgtttaattttttattaataattattttaaacagcttttctttaatatattgcggaaaaaagtgtccgatgtctccgtgacttttcatcctgagttcatcagtaatatcatattttatttttttggctgctaactcctttattaaaggtatgaaatctgaatcccagctagcatcattctggcttaacaataggtttacctttgttctagagcgatacggaatcgcatttaaaatgaggttatctaattgggatgcttccttttctgaatagtcggcacctaatagatcatttattacaacttgcccgccgcctccaatcaggcatttcttgagatatgaaataatctttgtctgaggcactccggagacaacatatccaaagttatattttaagccaaagtatagtgcggccgtgccacctttggaacttccaattgtaataacatttttgtattgtatgtttagatcctctagaacattgtctatcaattttttaacagttcgttcaaccgaaaaattcattttttcacataaataatagcagcctctggatccgcaggtatcctgaataaaaagttgatgtatattgaaatttgacattatattcaagtaattataaggatgttgttcttttaaaccaaatctattaaaacctgaaaatataatggcaagataatcacaaaatccctctgcttttcgcaggacataatgaatttctttctcagctttaaatagcttttcatttggcagcataaaaattaccttcctattcggttggatttttaataagtagacagagcttttctttccagtgatactggaaagaaaaaacaccgcggtgtttttttcgatattataaacgcctgtttgcaacaaaatcctaggcgcgtcttacctgtaattatatagagggggaaaggtgctgtcaacttttctcctcttatgttccgccctcttttttacatacgcctgcggactccgtcagaaccgctcaaaactggactgttgcgtaacataacgtgatatggtatactaaaacttacataatttcgcactccaagggcacgcggttttcgtctgttttgttaaaaaacagacacatgaccgatgacggcggccggaccaggttcgcggcgcagcctgcataaacgcggcgcccgccccactgtccgcggcgcagccggctaaagttttttgccaagctttttttcaaaaaagcagggcttttgacaaggagggtatctatgactgtacgcgatatccaaaaaattctgcgcgcagatttgctgtgcgaaggcgatcacctcgacgcccaggtgcacacggcctgcggcagcgatatgatgagcgacgtgcttgcatatgtcaaggatcagagcgtccttctgacggggcttgtcaatgctcaggtggtgcgcaccgctgagatgatggatatgctttgtattgtttttatacgcggcaaacgcccggacgacgcaattatccgtctggcgcagcagcgcggcatcgccgtcatgacctcgccctaccgcatgttcacagcctgcgggctgctttatgaaaacgggctgaagggtggctgtgaaacggatgtctgaatcaattaaattgacgtacaacgtgccgggcgacgatttcacacgcgcaggtgaagcctccagcgatgtcaagggagtgcttaaaaagctggggctttccccggctgtcgtgcgcaaggttgccattgccatgtatgaaggcgaaatcaatatggtcattcatggaggcggcggacagatcgcagttgaaatcggcagcgaggatatccgcatgtctctttctgatcatggccccggtatccccgatatcgcccttgcgatgcaggagggctggtccaccgcgcccgaggaggttcgcaatcttgggttcggcgcggggatgggacttcccaacatgaaaaaatattccgataaaatggagatcatcagcgcgcccggcgaaggcacaaccgtcaatatgatggtgcggatcgcttgattaacagctcaatcagtccctttttacacccaactgaagggaggccgtccgcatggatacggcgaatttttttcactccgtaacgctcgaccgcgacaaatgtcacggctgcatcaactgtgtcaaacgctgtcccaccgaggcgatccgcgtgcgcggcggcaaggccaaaatcatcaaggagcggtgtatcgattgcggcgaatgtatccgcgtctgtccgcatcatgccaaacaggcaatttttgacccgctgtctgttatggaccgcttcacctataaaattgcgctgcccgcgcccgcgctctatgggcagttcaacaaccttgacgatatcgatctcattctcggcgcgttgctgctgatgggctttgacgaggtgtttgaggtcgcgcgcgccgccgagcttgtctccgacgcgaccaggcgctacatggccagggaggatatcctgcgccctgtggtaagctctgcctgtccggctgtgctccgcctgatccgcgtgcgttttcccgagctgatcggacacgttctgccgatgcacgccccgattgaggtcgcagcgcgtctggctaaaaagcatgccgctgaaaagacgggcctgccgcccgagcagatcggcgcgatctttatcagcccatgcccggccaaggtgacggctgtcaaaatgccgcttggctctgaaaagagctgtgtcgacggcgttctggccatccgcgaggtctatcccaaactgatcagcctcatgcgcgaggtccccagttcggtcgatttggcgcgtacagggcgtatggggatcggatggggcagcagcggcggtgaagccgccgccgcgctcaaggagcggtatctcgcggcggatgggattgaaaatgtcatccgggtgctggaggatttggaggacgaaaaattttacgacctcgattttgtggaactgaacgcctgctccggcggctgtgtcggcggcgtgctcacggttgaaaacccgtatgtcgccagggccaagctcaagcgtatccgcaaataccgccctgtgtcgtgcaaccatatcgacggggaggatctctccgcctttttctgggacgaggcggttgagtatgagcctgtattggagcttgacgccgatttccgcacggcgatggaaaaaatgaaaaccatgcgcgaaattgaagcgcgcttatacggcatggactgcggttcctgcggcgcgccgtcgtgcaaggcgctcgctgaggatattgtacggggctttgccactgaggaagcatgtatctttaagctgcgcgaggagatcgacggcatggcggaaagcctgcgccgactttcacgcgtaatgccgaaggcggacggtgacaaatcaagatagggggcctgatcatgacagtccgtgaaactgcggatattctgcattttgaaattctgaccggcggcggcgcgctcgaccgcccgattcaaagcgtttactcctgcgacctgctttcgtttgttatgggccgcgcgcccgccgacagcgcatgggcgacggtgatgggcaatgtcaacgcgatggcggtcgctgtgctggcggatgttgcgtgcgtcgtgctcgccgagggcgcggcgctcgacgacgatgcgcgcgccaaggccgaacagaacgatatcgccgtattgcgcagcagcgatccggtatttgaaacgtgtcttgcgatctatactttgctcaatcgctgacggcgggccgcccgctgcggaaaaaggggggaagcggccatgcgtcctgtgttttatgatttgcatattcactcgtgtctgtcgccctgcggcgatcaggatatgacgccgaataatattgtgaatatggcgctgctcaaagagcttgagctgatcgcactgaccgatcacaactcctgtaaaaactgtccggcaattatgaaggcggcagccggcacaggacttgtcgtactgccgggcatggagctgaccaccgcggaggaggcgcatgtcgtttgtctgtttccggcgcttgacaatgcaatggcgttcgacgcctttgtccacgaacgcctggcgcctgtcaaaaacgcgccggacatctttggcgaacagcttatcctggataaaaatgacgatccgatcggtcacgaggaccttttgctcgtcaatgcgacctcgatcagtatcgatgaagcgcctgcggccgtagcgcagttttgcgggctgtgttttccagcgcacatcgaccggccaagcaacagcgttctgtcaaacctggggggcatcccgccggaatgcggctttcatatccttgaagtcgcacatccggaacgcttttttgccggcggtgcgcacagcgatcttcaggagggctatacggtcgttacaagttccgacgctcacgatctgggcaatatctccgagcgcatacgttgtatccatcttgaaaccatcgactacgccggactggcggcgcgtttattatgaagaaacgggaatggattattgttgcggtgctgctggcggcctgtatcgcggctgctttttttctttaccgcccaaaagaggcggccggcggcgtagttgcggttatctctgtagacggagacgagctgcgccgcgtcgacttgtcggccggtgaagcgtataccttccggattgaggaggaaaccggcaggccggtttcctttgaggtgcgtgatggacgcatccgttttatcgacgtcacctgccccgaccacctctgtgagcagacaggctggtgtcaaaaccccggcgaccgcgccgtatgcctgcccaaccgcacgtcgctgatctgttacgacaagacttccctgtaaggcgcgtccgccgtctgccgtatccttcgcggcgcggcctctataagccgccgcgcctgacccgctgtttgcggcgcggcctctataagcgcggcgcctaacccgctgtttgcggctcagccgaataaggtttttctccgaagccttttttcaaataggcttcggagaaaccggctaaagttttggggcatacctttttttcaaaaaaggtatgtggtataatatgcgcagtgcaaacgacaaagccgtttgcagccgccatatggcggcaaacgctgcaaagcagcggattgcgcatgttacactacagccaaaaccggctttgccggtttccctgccgctttgcggcaggcaagcccgaatgggcttgttgctgtggtataataaccgcagagcggttattataccaatcttatgcccaacggctcgccgcttacgcggcagccgccttttgatgggcaattataccatgccgcttcgcggacatggtatcataaccgcagagcggttatgataccaattttatggccagggcgatacgcgggcgcggcccgcttgcgccccgatggccgattaaaaacgggctgcggccgcgcggcttctgagaggtattttgcaatgcacgaacatgacccggaaaaaaaggttgttgactttgacaggcttcgccagatgcgaagggagcagggacgcgcgcgaaagcgcacaatccgcagagtgatcgcaggcgcggcagcggccttgctgctggtcggaacatttttgttcgtacagcttcgcgaggcgttttcaagcagcggcttctggcagaacttcagcgcttccgcacccgcggcgcatacggaaggcccggagcgcagcgcatgaaacgggaacggctttatattatccttgcgcttgtcaccatctgtttttgggggacaacctttgtttcaaccaaaatcctgctgggtgtgctttcgcctattcacatcatgcttttgcgctatgtgatcgcgtatgtgtcgctgcttgcaattcatccaaaaatccaccggccggaaagcctctccctggagcttcgctacatcgcggccgccctgttcggcagcacgctttactttctggcggaaaactttgcgctttcttttacccaggcggccaatgtcagcctgctgatttccgcggcgccgattctcacgtccgtcgtcgcgcatctgaccacacgcgacgaacatctgacgcgaaatgcggtcggcggtttttttgtcgccatgactgggattgcgctcgttgtcttcaacggcagctttgtgctcaaattatctccaaagggcgacctgctcgcggtcgccgccgcgctctcctgggcgttttattctgtgattctgcgcggtatccgctccagctacccgcctgtatatgtcacgcggcgcatctttttttattccattttgacgatgctgccatgtctgctgtttgacgccgcgccgtttgatacggccgtgctgaaggagccgctgatcctcggcaatctgctgtttttagggctgatcgcatcgtcgctgtgctatgtgctttggaattatgtcgtcgcagggcttggagcggtgcgttccaacaatttcgtctatttaaaccccctcatcacaatgatcgcttccgtcatcgtgctgcatgagcgcatcacgccgctgatgatcgcaggcgccgtattgattctgctcggcgtcattgtgtcggagggaacactattaaagcggcagaacgctgccgcccagaggtgattgattggacaaaaaacaaatcaagggttattgtaccgtcgctgcgtttaccgtcgtgctttaccttgtcctgagccatccggaacgcgtgggacaggttgcttcggcgtctgttcgcctgcttatgccgtttttcattggtgtggtcctggcatttgtcctcaacggcgtgatggaaacgtttgaaaagcatgtgttcgccgatctgcctcgccgttttccacggcgcgccggtcttgtacggccgctttcgttgatcagcacctatctgctggtcctggcggcactggtggtgctcggctggacggtcgtccctcagctcggtgaaagcgccatcacgctcggccgaaatatcccggcttatctcaactcgcttgccgagcttgccgcccgttttcagcacgaatgggtgctgccgcccgaattttacgagcagcttaccggctggctgtccggtctggctgattttctgctcaacttcatcgccgaatttgtgccgcacgcgctcaatttcgccgcgtccttcggcggcggtattgtaacgctcgtcattggcgtgatcgtctccatccatgtcctgctcacaaaggagcagcttctttcacaggcgcggcggctcaatcgggcgtttctgccgccaaaggccgcggacagcatcgccggcgccgcgtctgtcgcggccggcactttccgccgttatgtcagcggccaggcgcttgacgcgctgatcgtcggcgcggtcagcgtgatcggcctgtcggcgctgcgctttccatacgccgtgctgatcggcgtcgtcatgggcgtcacaaatgtgattccgtttttcgggccgttcatcggagcggtcccgggggtactcatccttttgatggctgatccgatcaaagcaatctggtatattctgtttgtcgtgattgtccagcaggtagacggcaacatcatcgcccccaaagtgatcggcggttcggtcggcctgccgccgctttgggtgctgttcgccgtcaccgtgggcggcaacctgttcggcatcgccggtatgattttgggcgtgccgctgttcgccacggtctatattttgcttggccgcgccgtgcgcgcccgcaatgtctgatccggccattctggcgcgcgtgacccgtgcgcgggtcacagcggcatcgtccgctatgacgtccgacgccttcgcggggctttccgaagcgcggcaatcgccgtgcttcgggcgcagacaagctgcggcagcgccccgcggcgcgcctcatgggacaggggcgggccgcccctatcccatggacccaaccccggggcaggcgcggcttgacgatttatcacagaacacaccggcgtgcgcccgaaaaatctgtgccaagcagaggcggggataacataaggggaggggcgccgacccgccccttgtgaggcgcgaaaaggggcgcagccgcggcttggccgcgcccggcgctatagcgccggaaagccccgaatagccggccgggcaagcaaagcggccggcggtgggcaatccgcgcacggattgcgcgcgccaaaagggaggtaaaaaacatgattgattcctgcggacgacatatcgattatatgcgcgtatccatcacggaccgatgcaatctgcgctgccggtattgtatgccggaggaccagccgtttattgagcacgaccaaatcctgcgctatgaggaaatcatccgtatctgccgcgccgcaacaaagctgggcgtgcgcaatatcaaaattaccggaggcgaaccgcttgtgcggcgcggctgctgtgagctgatcgaacagatcaaggcgctgcccggcatcgagcatgtcacagtcacgacaaacggagtgctgctcgctccggttgcgccgcgttttcgtgaaatcggcgtggacggagtcaacatcagcctggatacgctgcggccagatgtttacgccaaaatcaccggacgcgacagctttgacgctgtatggcgcgggctgtgcgcggctgtcgacgccgggctgcgcgtcaagatcaactgcgtaccgctttccggcgtcaacgaggacgagctgtgcagcctggctatgcttgcgcgcgactggccggtcgacgtgcgctttattgaaatgatgccgatcggtttgggcggctccatggagccggtgccggctgaggaggttcgtgcgcgcgtgcgcgaggcttttccagatttaacgcccgacccaaaaaagcatggattcggcccggcgcgttatttcaccagcggcgctctgaaaggttccatcggctttatcgaagccgtttcgcacagcttttgcaccggctgcaaccgggtgcggctgaccagcgaaggttttttcaagctctgcctttatcatgacgacggggcggatctgcgcgcgctgctgcgcggcggcgcgaatgacggcgagatcgcggaggcgatgcgccgcgccattctggaaaagccgcgcgcgcatgcgtttataccaggccaggccgccgaggaatcgcgcggcatgtcacaaataggagggtgatccatatgggaattgtcagagctgtctgcatcagcgaccggcgcggcatccagaaaatcgatgtgggcgcggccaccttcgcgccggactgcggcatcgtcaacgacgcgcaccgcgggacatggcaccgccaggtgagcctgctttcttacgacaaaatcgaggaatttaaacgccgcggcgcggatgtcggccccggggcgtttggtgaaaacctggtcgtggagggctttgattttcgcagcctgccggtcggcacgcggtttcaatgcggcggcgtgcttttggagatgacacagatcggcaaggaatgccattcccactgtcagatctatcacaagatgggggactgtatcatgccgcgcgagggtgtgttcgcgcgcgtgctgcacggcgggacgatctccgtcggcgacgagatgacagccatcccgccggcggccggcgcaccgctgcgcgccgccgtcgtcaccctcagcgacaagggcgctgcgggccaacgcgtcgacgaaagcggccccgcggctgtcgagctgcttgagcaggccggctatgaaatcattgaaacgctgatcctgccggatgagcaaaagcgtatcgagacggagctgatccggctttccgacggacggcaggcggaccttgtcgtcacaacgggcgggaccggtttttccgcgcgcgactgtacgcccgaggcgacgctcgccgtcgccacacgcaacgcgcctggtatcgccgaggcgatccgcgccgagtcggcgcgccacaccgaccgcgcgatgctcagccgcggcgcgtccgtcatccggggcggcacgctgattgtaaaccttcccggcagcccgcgcgccgtccgcgaaagcctggcgtgcatcctgccggcgctcggccacggcgtgcgcatcctcaagggcacggcctctgaatgcgcgcggccccaggcgtgaccggcagccgccgcgccggatagaagctgaaaaaggccccgcgccgccctttcagggctggcgcggggcctttttttcaagatttaaatccggctgtccgatgtgggcgccgggttgagaaacgggttatgtacgggcgtattcgcactgtcatactcgttttcatgctgcggcatcgggaccgttttgtctgccccggcctgctctgcaatggacgcagcgtttgccagcatcagcttgatgcggttttcctggttgatctttgtcgcgccgggatcgtaatcgaccgccacaatattcgactgcgggttgcgctccttgatgacgcgcatcattcctttgccgacgatatggtttggcaggcagccgaacggctgtgtgcagacgatgttgccggcgccctgctcgatcagctcgagcatctcggcggtcagaagccagccctcgcccattttgacgccgtggctgatgtagccgcgcaccagctccactgtatgcggaaagtatccgccgggacggaaggtgccttcggcgttgaccgcgtcgatgacgtcgcgctgttttttcaccagcatgttgtataccatccgcagcacaaacgtcttggccgcgctcatcaagccgtagagcttgtggtcgttgagctggttgtagacgcagtaaaggcaaaagtcaagcaacccggggacaacgacctccgcgccctcggacaaaaggaaatcctccaggttgttgttgccgagcggcgaaaacttgacatagatctccccgacgacgcccacgcggattttttcagttttctcgcgcggcagggcggcgaaatcgcggatgatcgcatcgtaattgcggcgcacgcgcttataactgagcagcccgcgccccttcatctctccggtcagtcggtttgcccacttgtccacaagcgcgtccgtcgcgcctggctccaattcatacgggcggcactggttggccagcagcatcagcaggtcgccgtaattgagcgcgtaaaacacgcggtcgagcatcatcggcgtcagcttgaagccgggatttttctccatgccgttggcgctgagagacacgaccggaatatagccgtagccgcttttcataagcgccttgcgcagcagatggatataatttgaagcccggcagccgccgcctgtctgtgtgatgagcagagcgactttgtgcaggtcgtatttgcccgactccagcgcgtcgatcatctgtccgatgacgagcagggcgggatagcaggtgtcgttatgcacgttgcgcaggccgctgtcaacgacgttctggccgctgttttccaaaagctcggccttgtatccatattcgcgcaggatgttgatcatcagcttgaagtggatgggcagcatcgttggtacgagaatggtataatcgcgtttcatttcctttgtaaaaaggacgcgtccgtcattttgctcaggcatggacccgcctcctttcctccacagcctccaggagactgcggatacggattttcaccgcgcccagatttgaaatctcatcgattttaagctgtgtatacagcttgccgccgtcctcaaggatggcacgcacttcgtcagttgtgatggcgtcgataccgcagccgaacgacacgagctgtacaagctccatatccggctgacgcgtcacatatttggcggcgttatacaggcgcgcgtgataggtccactggttgaggacgtgcacgcgcaccggctcctccaagtcggccacgcagtcctcgctgacaacggcgatatcaaacgacgcgatcagcgcgtcgatgccgtggctgatctccggatcgatgtggtacggccgtcccgccagaacaatgatcctgcggccggcggcgcgcgcctcatcgatgacgcgccggccctcggcctttacatcctgcatccaccggtcatacgccgcataggccgcgccggccgccgcgcgcacctcgcgctgggtgatatccgggaacaccgccgccagcgcgccgtgaatcttttcggcgaatttcttaggacggtgtacggccacatgcggatacagaaaatgcacgtctggcgcgtttaattccgcgacgtttgaatgaagcagctcgggatagtaggcgacgaccgggcagttgaagtggttgtcgcccttttgctcgtcaaagttatatgtcatgcatggatagaagatcgttttgacgccgcgctcgagcaggtccgcgatatgcccgtgcatcagcttggcggggtagcagaccgtgtcggaggggatggagaattgccctttgatataagtttcacgtgtcgacacgccgctggtcacaacctcgaaaccgagctttgtgagaaacgcgtgccagaacggcaggttttcaagcatattcagcccgagcggcaggccgattttcccgcgcgggcccggcacaggcgcaagcgagagcagcttttgcagcttccaggcgtacagattggccggcgcttcggcggcggcgcggccgagcggacgctcgcagcggttgccggagataaatttgcgcccgcctccaaaggtgttgaccgtcaggttgcagtggttgccgcacaatccgcagacagcggaacgcgactcatgctgaaaatctttaagcgccccggccgtgatgacggccgactgctcaagttccagctcacgcgcgtaaagcgccgcgccgaacgcgcccatcaatccggcgatctgcgggcggacaacgtcgtgtcccagctccatctcaaagctgcgcagcaccgcgtcgtttaaaaacgtgccgccctgcacgacgatgttctctccaagctccttggcggaatgggcgcggatcaccttgtagatcgcgttttttaccaccgacatcgaaatgcccgcggagatgtcctcgacggacgcgccctccttctgcgcctgcttcaccgaggaattcataaacaccgtgcagcgcgaaccaagatcgaccggatagcgcgcgaacagcccgagctttgcaaactgctcgacgccgtagcccatcgactgtgcaaacgtgctgataaacgacccgcagcccgacgagcacgcctcattgagcatgatcgaatcgatcgaatcgttgcgtaccttaaagcacttgatatcctggccgccgatatcgaggatgaaatcgacgtcggggttaaaaaagcgcgcggccttaaaatgcgccatcgtctcgacaagacccgcgtcgagcgtaaacgcgtttttcaccaggtcctcgccgtagccggtcgccgcgccgccgcggatctgcacgcggtccccgcagcgcggcagcagcgtttccagctgcgcgcgcaccagctcgacggggttgccgcggttggcgctgtaaaaatcgtagaggatgcgtccgtccccggcgatcagcacaagctttgtcgtcgtgctgccgcagtcgacgccgagatacgccgccccctcgtatgtatcgagatcggcgcgccccacggacgcctttgcatggcggtttgaaaacgcggcgtagtcatcgaggttctcaaacagcgggcgcagatggcgcgacgcgggcgtttcgttcgtcgtatcctcgattttcgccacaagctcgtcatacgtcagcggatcggcggccttttcagcatacagcgcgctgccgagcgcgacggcgtagcgtcccatatcggggaacacggcgttttcgggcgaaagcccgagcgagcgcacgaactcgcgctgcagggccttgaagaaataaagcggcccgcccagaaaaagcaccttgccggtgatgcggcgcccttgcgccaagccggtaatcgtctgatcgacgacggccttgaaaatggaggcggcgatatcctccttgcgcgcgccctggtttaaaagcggttgtatatcggattttgcaaacacgccgcagcgcgacgcgatggtatagagcttctcgctgccaagcgcgagcgtgtcgagctcgccgggcgtaacgtcgagcagcgtggccatctggtcgatgaacgcgcccgtcccgccggcgcacgaaccgttcatgcgctcctcaagcccaccggtaaaaaagatgatcttcgcgtcctcgccgccaagctcgatgacacagtctgtgtcgggcgcatacgccttgatgacttcgccggtcgcaaaaacctcctggataaacggcaggcccgccgctttggcgacgccaagccccgccgacccggaaagcgccacgcgcaccggctggccgccgataacgtcgcgcgccatgcggatcagctccagcgtctttggccgcacctgcgacatatgacgttcatattgttgatagacgacttggccgtcttttacgataataaccttaaccgtcgtcgagccgatgtcgacgccgatggtcagcgggcgaacacagtccgtcctgtccatgatagagcacccctctttgaaaagcccatattgggcgaacgccgtttattctatttccggggaaataggaaaacggacaaaaccgccgtacagcggccatttacactatcttaacacgtttgcggcacacggtcaatttgcgcctgcgcttaaattgttggcagttcgcgctgaatttgggggaatgtgcacaaatttactatactttaaaacaaaaaaatttcaaccaaaaaataccgccgcggcccgccggattttgtccgcggtctgcggacatcggcgggcgcgcggcgtccgtcattcttttttcatcttggccgccttgatcaccttcaggcgcgaaaattcctcccggtccttctcctcaagcgcgtcagtgataaaacgcgccgtctcgcggtagcgcgggattacaatgttctccagagcgtttgcgcggcgctgcgtcttgcggatggcgttggcaaggcggtaaacgctgttttccacctcggccagcagcgccgtgacgcgctttgccttctgaaagcagacatacgcgtaatcgaggcgtgaatttgtatggtcaaagccgtagcacatacggatttcgctttccgccagccgcacattcgggatttcaacgcccataacgctgcgataagtgatcgtcacaccatcctcgatcggcacggccatggccgtttcctgcacgacgccaagtgtgacgttcgcttcctggagcgcctcataggcgctgcggtacgtctggctgatctcgccgcgcagcgatttgacctggtcgatcagcagcatcatttcccggatcagaatattgcgcttgcggtcgagcagatcaaagccgagcgtcgacagctcaagcgatttctggacagcgatcaggctgcccttggtcggcgtgacattcaattcgttcggcatggatgtttaccccctttcccgcagaccggcccgcgcgtcagacgccgaactgcttggccgcctcgtccggcttgtaaaactgctcaagcgtgtttgaatcgacgcggtcaagctcctcgcgcggcagcagcgacaagagcgcccatccgagatcgagcgtctgctcgatggaacggttctcatcaaaccgctggcagacaaaatgcttttcaaacatccgtccgaatgtcatatatttctggtcggcaggggacagctcctcctcgccgatgacagacgcgagggcgcgcgcgtcctgcacgcgcgaatacgcggcgaatagctggttggagcagtcggagtggtcggcgcgcgtgtacccttcgccgatgccgtccttcatcagccgcgacagcgacggcagcaccgaaaccggcggatagacgcctgtctggtcaagctggcggtcgagcacgatctgcccctccgtgatgtagcccgtgaggtccggcaccggatgcgtgatatcgtcgttgggcatcgtgagaatcggcacctgtgtgaccgaaccgccgctgccctcgataatgcccgcccgctcgtaaagcgacgcgaggtctgaatacagatacccggggaagcccttgcgcccggggatttcgcccttggaggagctgaactcgcgcagcgcctcgcagtaggcggtgatatcggtcatgatgaccagtacgtgcatcccgcgctcaaacgcaaggtattccgccacagtcagcgcgcagcgcggcgtcaggatgcgctcgataatcggatcgtttgacaggtttaaaaacatgacgacccggtccatcacgccgctgtcctcaaacgaccggcggaaatagtcggcaatatcgtttttaacgcccatcgccgcgaacacaatcacaaaattgtcggcgcccggcccggaaaggcgcgcctggcgcaccatctgcacggcgagcttattgtgattcatgccggagcccgagaaaatgggcagcttttgcccgcggatcagcgtggctagcccgtcgatcgacgagatgcccgtgttgatatagttgcgtgggtaaacgcgctccaccggattcatcggcatcccattgatatccgcggactgttcgcagaacagctcgccaagcccgtcgatcgggcggccggagcctgaaaaggtgcgtccgagcacctcgggcgaaagcggcatctccatcggatggccgagcagcgttgtctttgtgttttccagcgacatgccgcgcgtgccttcgaacacctgaatcacggcgcgcccgcccatcagctccacaatgcggccaaagcgcgtttcaccgcttgtcaggcgcagcgaaaccatctcctcaaacgaggcggacggcacgccgtccagtacgaccagcgggccgttgatctcatgcagccctacaaactgtaacatccatccgcctcccttcaaagcatctgcgcgagcttggcgatccggtcgtcaatctcgcggtaatagctgtcgaacaggtcaagacggtcgttgggcacatcgtatttgatcttgaccagcttgtcgggcagacccgtttctataatttcggagacgggcagacccttttcaacgacagccctagccctgtcgtaaaaatagaggataacatccatcatcttcatctgcttgggcagcggcacataggtatcgtcacggtggtaggcgttctgctggagcaggccgacgcggatgatgcgcgcggcctccagcacaagcttctggtcgtcgggcagaacgtcctcgccgatcagcttgacaatctccatcagcttgttttcctcaagcagcaatgttgaaacgcgctgcctgcgcgccagaaaatcgggcgaaatatgttttgcataccacggcgcgaggtcgtcgaggtattcgctgtagcttgtcgtccagttgatggccggataatggcgcgcgtaggcgagcgccttgtcaagcgcccagaagcagcggacaaaccgctttgtattctgcgtgactggctcggaaaagtcggcgccctgcggtgaaaccgcgccgataatcgtgacggaaccttcggcgccgcaaagcgtctgcatatagccggcgcgctcgtaaaactgcgagatgcggcttgagagataggccgggaagccctcctcggcaggcatttcctccagccgcccggaaatctcgcgcagggcctccgcccagcgcgacgtggaatcggccatgatcgcgacatgatagcccatatcgcggtaatactccgcgagcgtgatgcctgtatagatcgacgcctcgcgcgccgcgaccggcatgttcgacgtgtttgcgatcagcacggtgcggtcggtcagcggttttttgctctttggatcctcaagctcgccgaactccttgagcacctgcgtcatctcgttgccgcgctcgccgcagccgatgtacacaatgatgtccgcatcgctccacttggcaagctgatgctgcgtcatcgtcttgcccgtcccaaagccgccggggatcgcggccgtgccgcccttggcgacagggaacagcgtatcgatgacgcgctgcccggtgatgagcggccggtcaatcggcaggcggcgcgccacgggacgcggctcgcggatcggccagaactgcgtaagcgaaagcggatgcgcctgcccttcgtcgtcccgcagcgtcagcagcgcttcgccggccgtatacgcgccgtccggcctgacacccacggccgtcccggaaagccccggcggcaccattgcgcggtgctcaatgatcgacgtttcgggacaaaccgcgaaaatctggccgcctgtcagccggtcgccctcccggacgcgcatggcaacgtcccattttttctgcatatcgagcgccggcaaatcgccgcccgccgggatgaacgcgccgtttgcggcggcgatttcgcgcagcgggcgttcgatgccgtcaaagatgtttgaaaggatacccggcccgagcgccgcgcacatcggcccgcccgttccctcgaccggttcgccggggcgcataccagtagttccctcataaacctggatggtcgtctcgccgctgccgacgctgataacctcgccgattaggcgcttatgaccgacaaacaccttttcctgcatttgcagcgcgccggcctccctgaccttaacgaccggcccgttgatggaataaaccgtattccgcgccatcggcgatcacccctgtccttcctgtgcggaggcgtcctccagcataaaattggagttatgataaaaccagtccttctgctgtgcgagcgccgaaccaaggctcaaatcgatctcgacgccgcgcgccttgttgaccagcacaacgccgccgaccggcacagccgcgtcgtcggcttcgactgcacagccgggatacagcttgcggatatcggattcaaagcgcaggtcgtcggcacgcaccttgatcacgctgccctccatcggccagtcatgcgcgagcgagcggacctgccccagcaaaaactccctgtacgcgccgcttttgcaaaacgaggccagctcgacgcgcgcctcggcaagcaactctgaaagatactgctcccgctgccggtacagcgcatgcttcatctgctgcgtttcatgggcgatctcgccggcagtgtcctttcgaatctgagcggcctgcgcctggatgtcgttatacaattcgtcataaaggcgcgccttttcctgttccagcgcctcgtccttcatccgctgcgtttcagcgcgaatcgcctcgctttcagcctgcacgcggttcatgatctcccgctcgaaatattccagcttttcggactgtatatctgacatggcctgtcacctcccgttggcagcgcggcttacagcttgacaccgatggcctcgctcacatatttttcgatggtctgcgacacatccccttcgccatgccggtcgggaatttcgacgatcagcgggcgtttctgcgtcagcttatagcggtacaccatcgcgggacaggtatcaatcaacttttccgtcatcagcacaatgccgatttccgaatcagccatcacgcgccgcagcgccgcgagcacctcgtcctgcgtatggatcacctcgccctcgatcccggcaagccgcatccccatcatggtgtcaatattatcgctcaaggtataaaatttcataagcacctttccccgcttttttaaaaaaagcttggcaaaaaactttccggcctttttgaaaaaaggcctcggcgaaaaacttcataccttttttgaaaaaaaggtatgccaaaaaactttagtcggctgcgccgcgaatagtgggttgagtactgcgtcaataccggctgcgccgcagacgcaaagcattccggcgcgcggcttacagcttattgatcagcaggatggagatcaaaagcccgtagagcgcgacgccttcgcccagcacgacgaagatcagcgccttgccgaacgccttggggtcctcggaaaacgcgccgatggccgccggggcagtggacgcgatcgcaatgcccgcgcccagacacgaaaggcccgtggccagcgcagccgccaaaaagcccatgccctggccggcgtctgaagctgtggctgtggcggcggccgcagcttcaggcgcttcggcggcggccccgaccgccataacggccatcagcgcggcggcaacaacaaacaagcccgcattcataacaaggcggcggcgcgcgcggcccgtatcacggttttttctggcggggagcagcagcaggagcgcggcgatgaccgcagcggttggaatcagatacagcatattgatgaacctccatacattcatttgctttcatccggcgtcacggcggcggggacaaacggtttcccatcgccgtcaaaataccggctgaacaattcataaaactccagacggagcacctgaatgccgacaatcaggccctccataccgatgacaaacagattgccggccacgatgacaatcgggcttgccgcgccgctgaccatctcggacagcgtaaatacgacggccatcatgcccgcatggctcaatacaaagcctccgacgcgcagaaacgacatcgtgttggaaaagaagcttaaaaccacctcaaacaattcaaacgcgccttccgtcagatacgcgcccattccctcagccgggcgggcggccatatgacggacgatttttcccagcggctccttgaacaggattgccgcaagcggcagcacaatcagcaggacaacgtaaagcggcgtaaacaggtttttgccggttataaacagcatggccgcgccgaacagaatagagccgtaaaacagcagccccgcaatgccgtttgcagaaaatacagccctttcataatcatgacgccggaagccggtccaaatgccgatcagaatggaaatgcagatcagcgccacgccgagcgcgacagccgccaaaagtactaaatttgtgttttcaggcgccataacctctatcggttttccgggcaggccgagcacctgcgtataaaacggcgtcaacagttcctcaaaaccgaatacagagccgtaaaacgcgccgaagatgcaggagaaaataccgatgcggttgattatgcgtccaagcacagcgcccttcatgcgccagaacagccatccgccgatcaccagcaaaagtccctggcccagatcgccgaacatcgcgccgaacagcaggcagtaggtgattgcgacaaacggcgtcgggtccggatcgccgtaggccggcacgccgtacatctcgacaaacagttcaaacggcttggcaaaccatccgtttttcagctttgtcggggccttcaggcgcttgtctgaatcatgcggccggatttcgacatccactccgtcgagcttttttattcccgcggcaaacgcggccgcgcggtcctgttcgatgaagccggtcagataaaacacgtcgatatattcgcgccgcagcacggacacgaagcgccgcagctcaaacgaatccgacagaaaccggatccgcgaatagatgcgcgtaaattccgcgttgttttcgcccaccacatccgcgagctgcttttttgtctgcgccagcgcgtcgcggttgcgcgcgatttgctcgcgcaggcgctcgagcgccgcctccggcgtcccatggatgaattccggcacgcgcacgcgttcaaagtaaagcgataaaaacaggtcgtcgatctccggggcgttttctgtcagcacaaaataggccccccattggtaatcgccctctatatcaaacgatttaaatataaacggacgttcggcataatactcgagcttgcgcaccccgtcgagcggaaggcggccaaaacgcacctttgtatatttgcaggaaaaaaggtcgtcgaacgccacgtcgagctccgccaggtgcgaaaggatcacaagccccgattcatcctgctcgatctcgctgtgcagatagttctgccgttcgcgcagcgccgtcgtcttttcccggaaggcggagcagaaatcctcgcagtagcgcgcctgaagcgcctcgcccgcagcccccggatcgtaatgcggcgtcagccccgcggccacgcccgcatcggtgattttggcgagcaggggcccatatggattttcctccgcgagcggtgtaaagccccggattcccccggcggcctgcaaaggcggctcggggtggaacgccccgctgcccagacattgcatgatcacgtcgtccaactgcccgaggtcgcccgcgatactcacgagcgccatttttgcaatggccatgaccagcctccatttctccggtcgtcccggtaattctttcaaagcccgaataaatacagaaaagaaattgttccaggccgctcctgtgcggctctcaggatcgcgcaagcatggcgccgatccgttcgggcggcagccggtagcgcacgccctcgatgatacggatgatgtcctccgtctccatcgcgcgcagcagcataaacgccagataaaccacctgcggctccgtggcgaagcgcagcgtccgcagcgtttcgtgataacggacgcgttccgtttccagctctatgaaggccgcctgcggattgatctgacgcccaagcgcggtctgcgaaagcagcttcataaaggcctgcgtgtccttcgcctcgatcatcgcctgcatctgacgcgggcggatacgccagtgataggggagcagcgtcgcgcggatgcgccctgcgtcggcattaaaatacgttttcatgcggaagatcgtgttgaggttcatcagctccgcacgcatcctgatcagccccgaaagctgttttgccgcgtgcttcggcgcgcgtgcggcgcgtaaaagcatcgactcgaaatagtatgtgcgcagcgccacctcgtaccgggtgaagcgcagcgaaccgccctgcggcgggtactgctcgcggcaggcgcgcaggatcgcctcatacggcgtcgcccgcacagcctcgatcagcccgtctagcgttttcgcctgcgccagcgccaccaaatcaaagcgcgcgtagctctgcataaagctcggcagagccgccaacaggtcgccgctgcccgaaatgataacgcgcagagccgacagaatcagctcgatctccatgtccggcacaatatagccatagatggcgccggcggccgcgccgggcacataatgcgtcagccgcgcgtactggtaaaacaagtcgcgccgcaaaagcgtctccagccggccgcgatggatcgcgctgtcctgcacgccctcgagcgcctgcgcgtaggcggtgtgcccgcgcagataggcggaaatctcctgcacgctctgcttgcgcagcaattcatcgtattggctggacgtcagcatccgcccaaaggccgcgcgcgccttggcggcgactgcgttttcactgtgccgcatcgccgtcacctgccgatgcagcggccgacgatctgacgcagccactcgtcatggcgcgccgtatagacgcggcgcagcgcctgcatccgctgctcattctttgcgcgcagcccggcaagggcttcgtcccggtccctctgggcctgctggcggacctgctcgacacgctcggccgcgtgcacgcgcatctgctgctgtatcgcgcgcttatcttcatccaggcgcgccagcgcttcgaggcgggcctgctgcgcctgctgcacgagctcgcgtcccctattgtcatattccacgagcagcttgatgacccgctccattgcatatccccctttgcagtgaaaaaattcgaattcttacccattttaattttatccagtgtaatccgtttctttttgatttgcaagcattttcaaaacagatttcacgcttttttgaattcctacgcatgatttacaaattttcgcctttgtttttgtctattttatcagatcacgtcaggaatcattcgtttcgctggaatataatttggctcctgccggaaaaatgcccgccaattgcttgattttcattatactgtttgttataattattatacatatagatatagaaacccagcgcgcggctctgcaccgcgcgccgccagagagggaggaacgcaaatcatgaaaaaactggtaggtatgatcagcctgctgcttgcttgtgtgacaatcctcgccgtgcctgtttcggcggtggcgatcatcacgggggacagcttcggcaaaacgtcaaacaaaccctgggaggttgaccgctacgccccggacgagtttgacacaagcgaaaacgaactgtatatcaccgtcggcccaaagggctttacaaccgcgcgcccggcagacaagcaggataaatactatgctgtgcagggcaaaaagctcgcggcggcccagacctcgtcgaacacatggactgcgactgtcaagatcaatgtggatgacaactggttctcatcgagcagcaacaaccgccgcgccgagttccgcgtcgatctcaaggatggctccggcaacgcaatcagcgagtccccaacgctcgcgctccagaagatgggcagcaaggcgccgtatatcgtctattacacctcaaagtcgaaaaccggctggagccaggcacgcaccttcgtcaacggcgacaaggaaattgagtatcttgaagtcgagccgggctggaacagcctgctgatcaagtgcgacaagggcgtcatctcctattacctcaacgaaaagaagcttggcaactgcacgctttccacaaatcagaaggacgtatatccgtcgtatttagcgctcggcgtctataactacaaccgcaccgacaccgtttcgttcgacaacctctacctctacgacggcagctatgtcatgcgccagctttcttccgaagcgcaggatgaacgggacgagcggctggaatcgcagtatgagaaaaaacgcaacagctgggaggacaaatatactgaatacatgtttaaccgcgattccgacgaggacgtttacctgaacggcaggaaggttctggagggcggcaagtggtataagcagagtacggtcaagagtaagctcaaagtgtccgacaaggatttcgatgttgaatacgacctgctgatggaaaagatcgatcagctcaccaccgaggacggcggtccggtcgaatatgaaacgcgtgaaaccaaggatatgcctgatgattactgggactattgattcccacttactcctttccagaacggcggatgcaggtgcatccgccgttcctttttattccgaatattgggaaaagtcaacaaaattttgcgccctttcttgacaagatgccgacttggtactatgataacgtcgtatgagtatcgttaaatcagggaaaaagggagcagccacaaatgaaaatcaaacgcggcgatttaagaaatattgcaatcatcgcacacgtcgaccacggcaagacgacgcttgtggacggcatgctcaagcagagcggaaccttccgtgaaaatcaggccgtgcaggagcgcgtcatggactccaacgatattgaacgcgagcgcggcattaccatcctggcaaagaatgcgtccgccgaatataagggcgtcaagatcaatattgtcgatacgccaggacacgccgacttcggcggcgaagtggagcgcgtgctcaaaatggtcgacggcgtgctgctgctcgtcgacgcggccgagggacccatgccgcagacgcgctttgttttaagcaaggcgctcgacctcgacctgggcgtcatcatcgtcatcaataagatcgaccggcccgacgcgcgcgtctatgaggttgtcgacgaggtgcttgaacttttgatggatctgggcgcatcggacgaacagcttgacagcccgatggtgttctgttccggccgcgacggcaccgcttcgtattcgccggaaacgcagggcgtcgatcttcagccgctgatggatacaatcgtcgactatatccacgcgcccgagggcgacccggacgaaccgacggcggtgctcgtctcgtcgatcgattacaacgaatacgtcgggcgcatcgcaatcgggcgtattgaacagggcgaattaaaggtaaacgcgcctgtcaccgtctgcgattaccacgataaggagctgttaaagcagggcaaaattacagctatctaccagtttacaggcgtcggacgcacacaggtacagtcggctacagtcggcgatatcgtcatgttttcgggcattgaggatatcaatatcggaaatacggtctgtgccgccggcgcgcatatcgccctgccgtttgtcaaaatctccgagccgacggttgaaatgaccttttcggtcaatacaagcccgtttgcaggacgcgagggcaaatttgtcacgacgcgccagatccgcgaccgcctctaccgcgagctgctgcgcgacgtatccctgcgcgtgagcgacggcgatacagccgactcgtttattgtctgcggccgcggcgagatgcatctttcaattttgattgaaaacatgcgccgtgaagggtatgaattccaggtcagcacgcccaaggtgctctataagacaatcgacggcgaacagtgcgagccgttcgaggagctgaccatcgacgtcccgactgaatattccggcgccgtcatggaaaagatgggcccgcgcaagggcgaattgcagtcgatggacccggtcggcagccgcatgaaaatggtctttatcatcccggagcgcggcctgttcggctataagagtgaatttctcaccgatacaaaaggcgagggcgtcatgaatacgctgttttatggctacgcgccgtacaagggcgatatcccgcgccggcaaaacggttctctgatcgcgtttgaaacaggcgaaacgatcacctacggcctgtacaacgcccaggagcgcggcacgctgtttctcggcgcgggcgagccggtctatgccggccaggtcgtgggcatgtcgccaaaaaatgaggatattgcggtcaacgtctgtaaacgcaagcagctcacgaatacgcgcgcctccggttcggacgacgcgctgcgcctgattccgccgcgccggttctcactggaggaggcgctcgaattcatcggcgacgacgagctgcttgaggtcacgccgaaaaatatccgtatccgcaaaaccatccttgaccattcgcagcgtatgcgcgagcagatgaaaaagaaataacaggcacgggggaagggcgtatgaaaaaatgggcggtacgtttcagcctgctgcttggatacacggtcccgtatctctatttatccatgtacatcgatttaacctatgggacccctcttttttacgccgcagccttgattggttatgtcatcctgtatctgttggcgggcaaaacgcataaccgccctgccgcactcatcggaacggtttggactgccgtttcttcgtactgcttcatgcagtatggctggacgcaggactgggaatggtattttaagccccttacagccgcgcagcttctaatggcgctgaccgcggccgcccttttcatccagcttctggccatacgaggcgctgaaaaaaacaagctataaaaaaaccgggccgccgcgcaaaggcacacgctcataaggaagtaatttaatcatgttgcagggcggcatagtcaaaaggctatgccgttctgctttttctctgccgttcaatagtctgcttgtcctcgtcctgttccagttccccgataaagttccagacaatttcaatcttctgtctgcggtgtccgctggacttgtccggcgcgtggacgattatcttcttgataaactcattgacgatagtaggcgttaattcccgtattcctacatacttgcggataacggcggcgaagctgtcaaaatccgtcctgtcctgttcgtaggtatcaacggcagcttgctctgccttgacaaactctgtcagttccttttgctccgcttcatactcggcagacagcttcaaaaatctttcgtggctgattgtgccgttaatatcgtcctcgtaaatccgcttgaaaatacggtcaagttcggcaatccgttttcttgcctgttctaattctttcttttgtcgctttacttccttttctgcttcctcaaacctctgttgataaaccacgctttgaaatctctgtatatcgtcaaagaacatagccgttacatcaaatatcctttgcaggacgaacagctttaaggtttcttctcggataaaatgcgcggaacaagtacctgtattgctcttgtagttggagcagacataatgctcttgtttgggcgtaaaactgtttgttgtgcaaaagtacagcttttcgccgcagtcagcgcaataaagcaagccggagaataagccttgtcgtcctgtctttgtggggcggcgtttgtttgctcttaattcctgcaccctctcaaatacttgttcctcgataatagcaggttgggtattgaggaaaatccgttgattttccgacgcattttgcagacgctttttcagtttgtgggatttagaataggtcttaaagttgactgtacagccggtatattctggacgttccaaaatccccgctatggactttgcactccattgatacggcttgtccggtaaaacctttccactctgttttgcatggtaggctttgattgtcaaaactttgtctaccgttagcatctttgcaatctgcataggaccttttccggcaatacacaaatcaaaaatcctctttatcacagcggcggcttcttcgtccacaatccatttctttttatctgttgggtctttcctgtacccatagggcggattggtacagaggtgttctccggcattgccttttgaccgcataactgcacgaattttcttgcttgtatctcttgcataaaaatcattgaacaggttgcggaaaggggtaaaatcgttatcgcctttgtcgctgtctacaccgtcattgattgcaatataacgaatatcacgctccgcaaagaagctctctgtgtagtagccgactttcagatagtcacgccccatgcgagacatatccttgacgataaccgtcttgacttttccggcttctgcaaggcgtatcatttcattccaaccgggtctatcgaaagttacgcccgatactccgtcatcaataaaaaatgtcgggtttggaaaaccattgtcagcagcgtatttgagcaggattttcttctgattagctatgctgttactttctccgtctaaagcatcctcttgtgataaacgggcatataaagcggtaatgttgtcgggataatttttctctgtcgtcatgttcattcctcctgtaatgaacgcccgacaaacaggttgctatcttcattatatcggactttctctttcttgtcagcaggcgttttgacggattccgattttataagccgttccattttgtcatagagcagttcagagccgccgcagcttgttgaaacttcataggttgtgccgccgattttatatgtaaccgtttcatgcagtggatttcccttttccggcagtaagttatcgtgtgtgatttcttgtttcctttccattcctttcccgtcctttccttgttttgtaatgtgataagtttcgtagcaagcataggaaaggggtaccctttccgtaaaatacgttgcaaaatgcttattgggaagtttcccaaaccctctgaaaatcctttcactaactacaacaccgaacaaagtgattttgccgaagttttgagaaagatttttcaaaaagttttcttatctcctactacgggaaagtttctaaaatgccaaataaataaccgtttaggaaaaaaatattttgattaccacaacttaaaattcttctctatcttgacactgtaaagtttaggatttataatatagacagtgtaaagattggaggaattagcatggaacagcaacgacagacttatcatcacaaggacttgcgaaacgctttgattgaaacaggtattcagattgtaagtacagagggagtaaatgctttttctttgagaaaggtagctgcggcgtgtggtgtcagccatgctgcaccttatagccattttcaaaataaagaagagctgcttgaagcaatgcaattatttatcacagatagattttctaaacaattagaaagtaccgttcaaaaaaatgataatgttgcagaaatattgaaagatatggggatagcctatgtatctttttttgtagacaatcctgcttattttcaatttttatattctcaatccaacataagaattgacttatcgttatcaataccagacgacgaaaactacaaaccttatatcatctataaaaatattgtaagtaaattattagagcagacgcactattcgggagaaaagcaaaatgatattatcataaccatttgggcttttatacatggtattacttcattagccaccatgaataatgtaaattatgataatggctggaaagagaaagtcactgattttatggacgtttttcaactttccttttttagataatataggagaaaaatatgattggggtttattttagcggaacgggaaatacaaaatattgtttagagaagtttactgctctatatgataggaatattgaaataactcctttagaagatgagggtacaatagaaaaagttatataccataaagacattatttttgcctatccaatctattacagcaacctgcctaaaattgtacgggattttatctgcgaaaattctgatatatggaaaggaaaacgcatttttgttattgcaacaatgggactgtttagcggcgatggtgtgggcgtatctgcaagattgttcaagagatacggcgcacaggtatggggtggacttcatttgaaaatgccggattgcatttgtgatgtaaaagcattaaagcgtactccggttcaaaataagcaaattgtcatgcaagcagaagaacgtataaaattatcggtttacaatcttaaaaacggtactccaacgaaagatggtttgggatttttgtgtcatattgcagggcttttaggacaacggctttggttttaccgtaaaacacaagcatattcagacagaatacagataaataccgatacttgtataaggtgcggtaaatgtgcattggtatgtcctatgaataatttgtcattatctgaaggtaatatgatagcagacggacggtgtaccttatgctatcggtgcgtaaatcaatgtagcaagaaagcaattactattttggggaaacaagtgattttccaacactctgtttatgattttcattgaaagtagtctgattagaaatgaggtggtgcattgcaacaagaaaaatggattttatgtcctgtatgcaataataaaacccgattaagaatacgggaagatacagaaataaagaaattcccactatactgtccgaagtgcaagcaggaaactttaatcaatgtaaaaaatctaagtatatcagttatcacagagccagacgcattgacgcagagccgataacacgcagagaaaaatgcggttgtcggctctgttattttgttttgaggtattgttatgctatttttcagttttgagaaactatttaataatatgtggttaaaaaaagcactactttaggagtggggtactttgaccatgaagatgaactctcaaatcatataatatgtctatataattcatattacccaaacgcctatgccgcttcatgctgcatgggcgtttgctgtaatagccccctactgggaagaaagggggtgaaaaaatggactattccccaaaatacaaggagcatattgagtacacctttgcagccttttgtaaaatcgttctccgcaacgccgccatatctgcctatcgggatataggtaaacagcgaaagcacgaaatctctcttgattatctcatggaggaacaatattataacccgtctacgacagacagctattttgatgaaccgataaaattaacgcaaccaacggaatttactgtgtgtggggagataatcgtgattgaagatgaacaactggcagaagtgttttccagtttgccgaagctgcggcaggaagttctggtactgtatttcttcttccgatatacggataagaaaatcggagaggtatacggaagaagccgcacgacagtaaactactggaagttagccgcattgaagcagctaagaaaagaatgggagcgattggaacatgaggaacgaaaaactgataccttttgaagtgattgaaaaagcggttgccggagagccggaagctatacactttgtcttgtgtcattacagaggctacataaaatatcggtctgtatttcaagggcattttaatgccgacattcaagacagattagaagcacagttaatcaaggcaatcttacagtttcgctttgacaggtaggaaatagcaaaaccaaagaaaaccgtcaaggataaaatgcacgcttcgcgtccttgacggctttctctgtctttgccattaggcagctaagagggtgcaatcagatagaccgcttgcgccctcaacctattatgataaatgttacgcagtagggggcaaaatatccttgatttatgcggctttcagagcatgaaaatcactcagacgatattttatactcatgcccttaaaaatggcgttctactgcgtaacaaattctcgccaatcccaatacaaagccaaaatacagtagcagctattgacttatctgctaattttgattattatatattcataaagcgaatagcagctaattttagcagcactaattaatagggggataatatgagaattagtaaagaattaatcaaagcagcttcttttaacccaacaaaaaagagtcaccaaatgtccataattgatatgtgtcaaaaaatagataaccaaactatttctcttcctttgtatcaaagggatcttagttggactgtagccaaatgtatatcactgcttaattaccaactcttaggaaaagcccctgtatcaccaatttcaataaatgttattttgaacactcaagacagtgttccccaagtatcctttgttgatagagaattactaaaggaggtagaaaggggacaatattcagttgtagatggtcaacaacgtttaacaacaaactacaaagcatatgtaaaccatgaagattttagaaacattgtattagatttaggaaaaggtatgtttacagaagtgcaaggtgcaattagaaatacacaaataccggtaggaatacttctttataaagatgatagttcactttttgagtatgctcaaaagcgttccaccctgaaatcgccagaggttattagcctgcttctacaaattaaaagtaaaataaaaaactataactatacaattaattcagcagaagatttgtctgaagatgaacaaatagaatggtttgaagtattgaataatgcaggaagtcgcgtaagtattatccaaatgagattttcaaaattaaaggctcatggaatagatatttatactcaatatacaaatttgttccgtaataaacttgtagaaataggctttgaagacttttttacacctcaaaaaactactgtatcataccctattgctgcgttaaatccggcgtatgaaaaattaacagaacgaaatcactctaacaactatgctccaattccatcagacactaaagaaaatcaactttgtagtttaaaacccgaagaactaaccaagtgtttttctttaactttagaagcattggatattgttttagattttttggataataatgaattgaaaaaaccagacaggatagattatattaactatctcatcggatattttatttttaatggtttcaaaattaatgacacccaaaaagaatttttgattgagtggtatgatagtgtagattttaccaacaaatcaaatacagatagacgaaatatttttaataaattaatagaaaatgaaatgtagtaaaatatcaagaaattgtgtagtgactaataagaaactgagaggaaattatttattttcctctcagtttcttattggtgaacctgtttgtcagccgttaggtttagtttgtttcaaaacttccttatcggtgttcaccaaaacgcgcggcggcctctttttgcctcctggctctctattacggcgcagcctgtataaatactggaacctgtcccactgttcgcggcgcagccgatgaaagttttttgccgaggctttttttcaaaaaagccggaaagttttttgccgggctttttttcaaaaaagccggaaagtttttttcaaaagggctggagcaaaatccgcgtccagccgcacagcgtctgtcacggattttgcttggggcaggcggctacgcctgaacgggtgtcttgcggcctgcgggccgcgcttttatgagggctgcggcccgggttcagggctccgccctcgaaaaaaggcaagacccacgaggggccttgccttttttctcacccgccgccttttgaaaaaggcgggcgaaaacttttgatcgccgcggcgtaaaagccgattacgaagcgcctgccccactgttcgcggcacagccgattaaagttttttgccgaggctttttttcaaaaaagccggaaagttttttggcttacctttttttcaaaaaaggtaagtttcaaaaaagcggggcgttacttgagggcttcttcgacggcgacggcgcaggcgacggtcgcgccgaccatcgggttgttgcccatgccgatgagccccatcatctcgacgtgcgccgggacagaggacgaaccggcaaactgcgcgtcgccgtgcatacggcccatggaatcggtcaggccgtaggaagccgggccggcggccatattgtccgggtggagcgtgcggcccgtgccgccgccggatgcaaccgagaaatatttgacgccgttctcatacgaccatttcttatatgtgccggcaaccaggtgctggaaacgcgtcgggtttgtcgagttgcccgtgatggaaacgtcgactttttcgtgcttcataatggcgacgccctcgagcacgtcgttggcaccatagaccttgactttggagcgttcgccgtcggaatacggcgtctcgccgatgaccttcagctcgcttgtggcgaaatcgtagtcggtttcgacatacgtaaagccgttgatgcgggaaataatataggcagcgtctttgccaaggccgttgaggatgacgcgcagcggctctttacgggccttgttggcgttgcgggcgatgccgatggcgccttcagcggcggcaaacgactcgtggccggcgaggaagcagaagcacttcgtctcgtcgcgcaggagcatcgcgccgagatttccgtgaccaagtccgacggaacgcgtctcagcgacagaaccgggcacacagaaggcctgcaggccgatgccaatggcctcggaggcgtcggcggcctttttgcagcccttcctgagcgcgacggccacgccgagcgtatacgcccagacagcgttttcaaacgcgatgggctgcacgcccttcacgattttttcaacgtcaatgcctttatcgaggcagacggcgcgcgcatcctcaagggaagccatgccatattccgccaggcacgcgtcgattttgggcattcttctttcctgtccttcaaacttaaccatgttgttacctccctctccctttattcctcacgcggatcgatatacttcggcgcgtcggcatagcggccgtaggtgccgatattcttttcatacgcttccttcgggtcgacgccgtgacggatgtcctcaagcatcttgcccacgcggacaaacttgtagccgatggcctcgttgttgttgtcaaccgccacagacaggatatatccttcggccagctcgagatagcgcacacccttggcgttggtggagaagatggtgccgacctgcgaacgcaggcccttgcccagatcctcaagccccgcgccgatgggcaggccgccctcggaaaacgcggtctggctgcggccgtaaacaatctgcaaaaacagctcgcgcatggcgacattgatcgcgtcgcagaccaggtcggtgttgagcgcctcgagaatcgtcttgccgggcaggatttcgccggccatcgccgcggagtgcgtcatgccggaacagccaagcgtctcgacgagcgcctcctcgatgacgccctccttgacgttcagcgtcagcttgcacgcgccctgctgcggggcgcaccagcccacgccgtgcgtcaggccggaaatatccttgatctcataagccttgacccatttgccctcttccgggatcggggcggggccatgcttggggcctttggcgagaacacacattctctccacttcatgggaatagttcatatcggtgctcctttcggttttttaaaacgggttgtccttttcttattataggcatttcaccgcgcgcacgcaaggggatttgttcagcttttgttaattcttggacaacaatttcgccctgatttcgggtgattttttgtatataataaagatatccgtctgcgcgcggccgcaaacgtttaaaaacactggaatctgttgacattgacggcggctgggagtaaactatataagttgaattgtgcgcaaatgcaaaggcgcccgcgcgcgaagggaacctgtgaagcggtccaaataaacgacgtttctttgcgctgccagggtcgggaatataggatgaggtgacaaaatgggtctgattaaaaaactgttcggaagttattccgagcgagagttaaaacgcgtttatccgatccagcaaaaggttcttgcgctggaagaaacatataaggccaaaagcgacgccgagctgaaggctgtgacgccggcgcttaaagaacgcctggcaaacggcgagacgctcgacgatattctgccggacgcgttcgctgtctgccgcgaggcgagcgaccgcgtgcttgggatgcgccatttcccagtgcaggtcatcggcggcatcatccttcatcaggggcgtatctccgagatgcgcaccggcgaaggaaagacgcttgtcgccacgctgcccgcttatctcaacgccctgaccggcaagggcgtgcacatcgtcaccgtcaacgattatctggccaagcgcgactccgagtggatgggcaaggtctaccgtttcctcggcctgtcggtcggtctgattatccacggccttgatacgcagcagcggcgcgacgcctacgcctgcgatatcacctatgggaccaacaacgagttcggctttgattacctgcgcgacaacatggtcatctacaagcgcgacaaggtgcagcgcggccacaactacgccatcgttgacgaggtggactccatcttgatcgacgaggcgcgcacgccgctgattatctccggtcagggcgacaagtcgaccgacctttatgagcgcgccgaccgctttgcacgcacgctcaaatgctaccgcgtcgccgagacggactccaaggaggagcatgacgacgtcgacggcgattatatcgtcgatgaaaaggccaaaacagtcacgctgaccgcctccggcgtcacaaaggcggaggaatatttcggtgtggaaaacctgaccgacggcgacaatatgcagctccagcaccacatcaaccaggccatccgcgcccacggcatcatgcagcgcgacgtggactatgtcgttaaggacggcgaggtcatcatcgtcgacgaatacaccggccgcctgatgctcggccgccgttacaacgaggggctgcaccaggccatcgaggccaaggagggcgtcaaggtcgagcgcgagagcaaaacgctcgcaaccgtcactttccagaactttttccgtatgtacgacaagctcgccggcatgaccggtacggcgatgaccgaggccgacgagtttatggagatctataagctcgacgtcatcgaaatcccgacgaacaagcccgtccagcgcgtcgaccaccacgacgttgtttacaagactgaaaaagcgaaattcaacgcggtcattgaaaacattgtcgaatgtcacgaaaagggacagcctgttctggtcggtacgatttcaattgaaaagtcggagctgctctccgggatgctcaagcgccgcggcatcaagcacgaggtgctcaacgccaaataccacgagaaggaagccgagatcgtcgcacaggccggccagtacggcgcggtcacaatcgcaacgaacatggccggacgcggcaccgatatcatgctcggcggcaacgcggaatatatggccaaggcgcagctgcgcaaggccggttatgacgacgaggtgatcagcgaggcgacgggctttgccgacacggacgacgagcaggtaaacgaggcgcgccggatgttccgcgagctgatggatcagtaccgcgctgaaatttccgttgaagcggagaaggtgcgtgcggctggcggcctgtttatcatcggtacggagcgccacgaatcccgccgcatcgacaaccagctccgcggccgcgcaggccgccagggagatccgggcgagacgcgtttttatatgtctctggaggacgatctgatgcgtctgttcggcggcgagcgcatccagagtatgatgaatatgatcggcgccgacgacgatatgccgattgaagcgaaaattctgaccaattccattgaatcagcgcaggcaaaggttgaggcgcgcaacttcggaatccgtaaaaatgtcctccagttcgacgacgttatgaaccgtcagcgtgagatcatctattcacagcgcgacaaggtgcttgacggcgaggatatcagcggcatcatcaagaacatgatcaaggagacgatcgactccaccgtcgaccgttatcttgttgataaagaggtccatgacaactggaatctcgagggcctgcgcgactacttcctcggctggctgacaacgcaggaggatctgcgctacacgaccgaacagctcggcgaggtgacagaccagcagatcaaggatatgctgggcgaccgcgccgaaaagatctatgcggcgcgcgaggcgcagttcaccccgccgatcacgcgcgagatcgagcgcgtcgtgctgctgcgcaacgtcgatatgaagtggatgcagcacatcgacgacatggaggaactcaaacgcggcatgcacctgcgcggctacgcgcagaaggacccggttgtcgaataccgtatcgagggctttgacatgttcgacgcaatgatcgaatcgatccgcgaggacacggtcaagatgatgtttacaatccgcctgcgcactaacgaggagccgaagcgcgagcaggtcgccaagcccgcgcaggagagccgtggcgaaagcgacggcacgcttgaaaaccgtccccgcaccgtcaaaaaggtcgggcgaaacgacccctgtccctgcggaagcggcaagaagtacaagaagtgctgcggccgcgacgccgaataacccccagcctttttgaaaaaaggcttcggcgaaaaactttagtcggctgcgctccagcctttttgaaaaaaggcttcggcgaaaaaattagtcggctgcgctccggcctttttgaaaaaaggcctcggcgaaaaactttaatcggctgcgccgcaaacagaaagattagcgcatcgtaatcaaaagttttcgcccgccttttgggggaggcggcgggtgagaaaaaaggcaaggcccctcgcgggtcttgccttttttcgagggcagcgccctttccccgggccgcagccctcataatagcgcggcccgcaggccgcaagagcctgttcagacgcagggtcttccgccagcaggaggcgtgccagacgccgcgcgtctggcgcgatctcctgcaagctttcaccgttttgggagaacgccgctctgtttttccctccgtccattctaacgccaaaacgccccgcaccgccgtctgccggccggtatggggcgtttttaatcttatctctatgcgccttacgattttggcgggcaatagggcaggtcccactttgaaacctccaacccctttgcgcgcacggcgtcgatcaattctccaaggatagaagcattgtcgctgctgaccgcgtgcagcagataaatcgctccttcatggataaacttttccgtataggcgagcgccgcatcatggccgcgctgatcgttcggatcgtaatccttataagcaaaactccacagacaggttgtatagccaaggctttgcgccatcgcgagcgtctgttcgctgaaggcgccttcgggcgggcgatagagagtcatctcgtagccgaagttctccagcacatagttgtgaagctcgcggatatcctcggccgcatcgtcaagcgatttggacgttggattccagtgatggcttgtgtggttgcccacaacatggccttcatcgatcatgcgctgcacaagctcaggacacgactgcacatacggcagcgtcacaaaaaagacggcgctgcaatttttctccttgagcacatcgaggatttcctctgtataaccgttttcatagccttcatcaaacgttaagtaaaatttgccgcagtcgtccggtgcaataaaccaggcgctgtattctccatattgctcctgcaagccgattggagcgaccgtccggtttgcttcgtcgacctgcacgcctggcccccacttgatctggctgccgcccagagcaccgattttgtcaaaatcggtgctcatggtcggcgttaccatactggccacgccggaacggatgtcgctcgccacatctccaagatcggaggcaaggccatgcgaagccgcggaattcggcgtggacggggtagacggcgtcgacggtgtggacggagccacagacgcggccgacgacgaatgcgcaacgctcgacgactgcatattatcctgattgcgggacgtacatgcggccatggaaacgaccagcgcaagcgtcaaagccgccgcgaaaatcgctttgatagctttcattggatttcttcctttcacaattaaactgggaaaccaagaaatacagcttgaaataacatggttacttcggtgttagtgtgtgcagaaaatgaaaaattactactttggataatcggtataaatttccaagttataatgttttcctttattaagtgcgctgaatgattcattttcaggcgcttcttttactatttttacagaagttaattgtccatgccggttataaaaccggcatggacaattttaaggccttgttttcagttttgattgccgcgccggcgcagggtgtcatatttaagaattccaagctgcgtttttgcatctggaatctcaccgtcgagcaccatctgcaccgctttttccacaggaatgcgccggacagttaaaaactcatcttcgtcaagatgctgccgcgactgatgaaggccggtcgcaagaaaaatatgtatgatttccgtatcgtaagcacaagttggatacatcttcgcaagcggtacaaaacagtccgccttgcatccgcattcctccgataattcgcgcacgccgcattcctgcgggttctccccgcgctccagcttgccggccggcaattcgagcatgacgccgccgaacggataacgaaactgtgatacaaacaaaatatgctcatgctcatcgatagccaaaaccgccacgccgcccggatgatcaatcacctcgcgcgccgcgtgatttccattttccagttctactgtgtcgcggcgcagcgtgagaatttttccctcataaatcaccttggaatcgattgttttttcataatgagccaatttggcaacccccttgctcatcccgccttgctgccgggaactgagtttgcatgtccgcctcaaatcccctttttttgtgccgaactgccataatacaagcgttttggcacatacactgggcttagaggtgaaacaatatgtttgacggattttacaaacagccgccccgctttgagcatatccggcaggcagtgtgcgctctgcgcgatgaatacccgtttatacatgccttcccgattggcaaatccgtacttggccgcgggctttatgcgcttggttttggcaaaggcggcagcggcgcgctgcttgtcggcggcgtacacggaatggagtggctgacaaccatgctgctgctgcgcttcgccgaggatgccgcacgcgccatatcaacatgcgagccgttggctgacattgatctgacccatacccttgaaaaccggccatttacactcatcccgtgcctcaaccccgacggcatggaaatttcacttggcggcgccggcacagcgggccatttacaggcgtttgtagaaaaagcgagcggcggcgacacgctgcattggcaggccaacgcacgcggaatagaccttaaccacaattttgacgccggttttgaacaggtcaaaaagcttgagcgggcggccggtattgatgcgcccggtccaacacgctacgggggccacacgccccacagcgaaccggaaacacgcgcgcttgtcaacttttgcgccgccttcagaccgcgtactgcctatgcgttccattcccagggagaagaaatctattaccgctatggtccgcatacgcccgccagaagtcagcttatggcgcaggtcctcgcttcctcatgcggttaccggctggcgtcgccggagggaacggcttcgcatggcgggtttaaagactggtttattgattgtatgcggcgtcccgggttcacattcgaaatcggccgcggtaaaaacccgcttcccattcaggaatttgaaccaatttatgcgcgtctggtcgagacgcttttgatagcgacgcttctttaatccataaacgccttcccgctgcggcacataaaggatttttatagattgctgtgcaatctataaaaatagttgcaaagcaactattttggcaaaattgtccccgccatgggaaagtatatttgattgatttagacctgacgcgcatggagccgacgatctatttttatattatactgctattggacaaaaaatacaatagatcaaaaagagcttgtcctcgctttggacatctatacaaatgcgcgccttaggcggaaaaggcactcaaaccggcaaaaaagggactatacaaacattcccgtttccgatataatgaaattatatagcgtaaaaagtgtataaaattcaagaaaaatgaagtggtgaacagcttggatatttttatgatcatcagtatgttaggcggcctggcaatgttcctttatggtatgacactgcttggcagcggtcttgaaaaaacctccggcggccgtttggaacgaacgcttgagaagctgacggatacggtgatcaagggcgtgctgctcggcgcgcttgttaccgctgccatccagtcctcctctgcgacaactgttatcgttgtaggtcttgttaatgcacgggttctcaaactgcgcaacgccatcggcgtgatcatgggcgctaacatcggtaccacggttacagcccatatcctgcgcctgtccgatctcgattcctccaacctttttttccgctttctcaagccgacaacgcttgcgccgttggcctgtattgtcggtatccttttgattatgacggccaaacgcaacaaggcccgcgatataggctccattttcattgggttcggtatcctctttactggtatgtttacgatggaatcgtccgttaagccgctcgcggagctgccgcagttttccgcggcctttgctgcgatgggcaacattcctctgctcggtgtgctcgtcggtgcaggcgtcacggcgcttatccagtcgtcgtcggcgtccatcggtattttgcaggcgctctcctcgacaggacagatcaccttcggcatggcctttcccatcatcatggggcaaaatatcggtacgacgatcacccctattctcgcctcgatcggcgcgaccaaaaacgcaaagcgttccgcctgtgtacatgtgaccttcaatgttttaggtaccgtcctgtttttcatcggcggctatgcgctccagtctatccttcattttgccttctgggatttgccggtcgataaaggtatgatcgctaatttccatacgatattcaatctcaccgttaccattctctttataccgtttgtcggagttctcgaacggattgcctgcaccattgtgaaggataagccaggtcaaggtgaacaggaaatcaccgcagcctcgcttgatgaacgcctgcttgtatctcccggccttgcgcttgagcatgtgcgcggcgccgttgtacagatggcgttgcttgctcgctccaattttcttgattccgtcgcgctgctcgatcgctatgatcaaaaaatagccgatcggatacaggaaaatgaggatgttgtcgataagctggaggaccgtgttgaaacgtatctgctcaagcttggcgaacgcgagctgtctgaaagtgaaaaccgcagcatatccgagctgctgcacacatgcggtgaatttgagcgcattgcagaccacgcacagaatattgcagaatgcgccgaccgcatggtcgatacaaagacgactttttccaaaaaggcgacagaggaaatgcatacgatcagcgaggcagtccatgaaatcctcgatcttgcggtcgatgctttccagaatgtcaaccgcactgccgccgccaatatcgcgccgctcgaggaggttgtcgacgagcttgaacaaatgctaaaggacaagcatatcgaccgtctgcgccgtggaaaatgcaccgtcgacgctgctttcccgtatgttgaggcgctctccaacattgagcgcatctccgacctctgttcaaatgtgggtgaatctgtactgacctatgacagctcacttgttgaaatcgaccgccacgcttacaaacggctgcgcgctgaccagcatgataccggttatcaggataagtatattgtttacagtacgaaatattttggaaaggtaaaacggacgcaggacaaataatggatatccgtcgccccgtctatttcttttctcctcccttgtggggcacggttcgccgggttttccggcataaggggttaatcttctcttttttgataatcaggcgatcaactgcattccatctgttctttttgcctctgaacggaaaagggctgttgtcattgtgaaagcgatcaaaaatgaggtgagtatatggatcaggaggaccatatctgtaaaaactgtgcatatttcaggcagcattatgtcaaactgggttggagctaccgtgaaattaaattcggtcactgtgtttacccgcggctgaaaattcgtgaagcaggcgccaaggcctgcacgcattataagcagcgggagcatactacctctgccacaacataaaaacggccccttttggggccgttttttttcctttatctatcctctgccgttttgtcagtttcgccggctgcttcgtcccccgcggcgatttgtgattcctcctgcccgtcatccccggaagtctcctccttgggagcgcgcgccagggtcacaacccggctctcctcggatacgcgcattgcgcgcaccccgccgccatagcgcgactgtacagtgatctcacgcacaggaatacggatgataacgccatcgtcggtgatgataatcacatcgtcatcctcgtcgaccatgcgcacacctgcaaccggcccgttcttatcgacataatagttgcggattcccttgccgccgcggctttgcagacggtactgcgacacctctgtacgccggcccagtccgctttcggagacagtcagcagcgtcgcgccgctttccttcctgacacgcgccattccgacgacttcgtcgccgtcctccagcgtgatcgccttgacgccgcgcgctgtacgcgacaacggccgtgcgtcctgctcatcgaaacggatcgccataccgtttttcgttgcgataatcagttcacttgtaccgtccgtctgacgcacccacgccagctcgtcgccatcgtcaagtccaattgcaatcagtcccatacgccgcacatttttatacgcgcccagcggcgttcgtttaataatccccttgcgcgtcaccataacaaggcagcgatcctcacgctcatattcgtcaggcgtcaccttaataagagccgttaccttttcgtcgctgtccatcgaaaggagattgacaatatttgttccgcgtgatgtacgcgacccttcgctgatttcatagcccttaaggcggaagcaccgtcccttgcttgtgaaaaacatgatgaagtcatgtgtggaacagataaacagctcctcgacgaagtcctcctcacgccgcgtcattccgctgacgccgcggccgcctcgccgctgcgtcctgtatgcgtcgaccggctggcgcttgagatatccaaagtgtgtcagcgtaatcacacagtcctcaaccggaatcaaatcctcgatatcgacctccccgctgacagcgacaatctctgtgcgtcgctcgtctgcgtatttggcgcgcaggactcccaattcctccttgacgatcgacatcacacgcgtatagtcgccgaggattgcctcatattcctttacgcgctccaggatttttgcaagctcctcctcaatcctgatccgttcaagacctgaaagctgtccaagctgcatagccacaattgcggtcgcctgaatatcagtaatgccaaagcgcgcgatcaaattgactttcgaatcgggacgatcctttgaatggcggatgatcgaaatcacttcgtccgtattgtcgcaaacgagcttaagcccctccaggatatgctcacgctctttcgcacggcgcaggtcgtacttggtgcgccgtgtaacaatttcaccctgaaaatcgatgtaatgtgtcagtacatccttcagcggcatcaccttcggcacgccgcccacaagcgcgagcataatgactccaaccgtatcctgaagctggctgtaactgtacagacggttcaacaccacctgcgcatttgcgtcgcgctttaattcgatcacaatgcgcataccgtcacggtcggattcgtcgcgcagatcagaaatctggtcaatgcgtttatccttaaccaggtcggcgatcgattcaatcaaacgcgctttattgaccatatatggaatttcggttacaacaatacgctcccggccgtttgccatctcctcaatttccgtgcgcgcgcgcagcgtcaaccgcgcacgccccgttgcatatgcggcgcgtattcctgcgcgccccatgatcacgccgccggtggggaaatcgggacccttgatatgctgcatgatctcgtcaaggcccgcgtcggggttatcgatgagcagattaaccgcatcgatcacctcgccgagattgtgcggcggtatgtttgtcgccataccgacggcgatacctgtcgatccgttgcacagcaagttggggaaacgcgacggcagaaccgtcggctcctgaaggcggtcgtcatagtttccggtaaaatcaactgtttccttttcaatatcggtcagcatagaaagcgacattttactcatgcggctttctgtgtatcgataggctgccggcggatctccatcgaccgagccaaagttgccgtgtccatcgaccagcggataccgcatggaaaaatcctgcgccagccgcaccattgcatcgtaaacagacgcgtctccgtgcggatggtaacggccaagcacagatccaacggtatcagcacatttgcggtacggcttgtcaggcgtcaggccgttttcatgcagcgtatacaggatacgccggtgtacaggctttaatccgtcgcgcacatccggcagcgcacggctgacaatcaccgacatcgaataatcgagaaacgaccgtttcatttcatgctcgatatcgacattgtgaatgcgctgttctatcagaacgggatcaaacgcctcgtccttggcgtcgtgttcctgtttcatccgtatcatctcctatcattggggaacttttgccgttcagcgccgtcccatcttagccatcgcgcgccgttcggccgcgctgtaaaccttttcaaaccggtcgccgagcgcctgtcccagcagcgcgcgcagacgatccaacaaatcgtcgtcaagctgatttttcggaatgccaaagacacgccccttatcaaaggcaacggcatagacgccttcataatcatatacgttgacggctcctgaaaaggcgatatagtaatgagcgccgccctctgccacatcgataccgtctgcgtttaccataagcacatattccggcgacccggcttcgcgcgcggcggcagccttctgattgacatgcttcggataaaacaggatcaacccaagcagtgccagtgctgctgcaatcataatccaactgacaatctgtcccgggtcctcgaacgcataggggacaaacatccatagcacaacaaacacacccaggatttccatattgcggtgcatatcaatcttatttttcttatcataaacctccaacgccttgagtacgtcgtcgcggcgtgtttgaaaagtaatgtgcagcacatcattttcctgcgtccgcacgtccgcatcgtctggctggcatcccggcagtccgccggccgcttctccgctcatacgtcatacctctttttctcaaagtttacacagatatcggaaagcagcgcctccatttcctccctgtgttctccggcctgactttttggaattaacaggcagcgccgctccgccagcatgatcatataaagcccggaacttacgcggatggaatggatcgtgtgccaatatgtctcgacgcgctgttcgttgacatgctcgacacacttattggggtagaaatcaaccaccatctccgcatgcaaataattcagtttgttgtattctttcgttactgcacgtataagcgccttatcataaaacaatttgtaataaaaaaggctgcgaaaaccgagaaaaaagaccatcaaaagtaggatcattgaaaccggcgtcatgggattgatgcccgcaactgtagtcccaagcaaaaaaagtccgatcaacagcacaatcgcgcccatgattgtcatgcgctttttatttttgtcaatgctgtcagccgtcatgacccggtaaaactcgatataatcgtcaagcggcagatgaaatttgagcgtaaacagcttttcatatgtggacgccgtctcgccgtcttccgtttcatccgcctgctttgccaaagcgtccgattcctttgcttcagccggcatctgcgccgtttcctcctgcatgacttgcgccggttgattctgctcagacggcgcgccgctttgttcctgcacatccccggccggcgcttcgtccggctgctgtctgctgttttcctgttcctgcatgtgtcgtctcctttccagccccggtccaaaagcccgttcgcctccatcaaatatcaaggttctgaacgtatttggcattttgctcgataaagtccttgcgcggcgctaccttgtcgcccatcagcactgtaaagatttcatcggcacggatcgcatcggccatctccacccgcagcatcgtgcggttgcgcgggtccatggtcgtctcccatagctgttcggggtccatctctccaagacccttataccgctgtacatccgctttcccgcttccatccgggcaaagctcgcggatatactgatcgcgctcctcatcggaaaatgcataccgcacctgcttgccgcggctgaccttgaatagcggaggctgtgcgatacaaacatgaccatgttcgatcaaaggacgcataaaacggaaaaagaaagtgagcagcagtgttcggatatggctgccgtcgacatcggcatcggccataatgataaccttgccatagcgaagcttttcgatgtcgaattcatcgccgataccggtcccaagcgccgtaataacaggcatgagcttgtcgtttccatacaccttgtcgagacgggccttttccacattgagcattttgccccacaacggcaaaatcgcctggaaccgccggtcacgtcccatcttagcggaaccgcccgccgaatcaccctcgacgatatagatttccgttccatcccggccgcgctgcgaacagtcggcaagcttaccaggcagggaagccgtctcaagcgccgatttgcgccgcgcgacatcgcgcgcacgtcgcgcagcctctcgcgcgcgcgaggcattgatcgacttttcgataatcgccttagcaaccgccgggttttcctcgtaatacgtcgtcagcttttcatagacaagggaactgaccattgcacgcatctgcgtgttgcccagcctcgcctttgtctgtccctcgaactgcgcgtctgtcagcttgacggaaacaatcgctgtcagcccttcaagcacatcctcgcccgaaaacttttcatcgtccttaagcagcttatatttatgcgcataatcgttcattgtgcgcgtcaaagccgttttaaagccggattcatgcgtaccgccatccgtcgtgtggatattgttggcaaatgatagaattaaatccgtataactgtcgttatactgcatggcaacctcggctgtattatcgccgtcgcgcgccgccaaataaataatttcgtcatgaatcggctccacaccctttgatttatggatgtgttcaacaaagcttcgaatgcctccctcgtaatggagatgctcctcaaccggctctgtcccacgctgatcgcgcagaacaatataaacgcccgcgtttaagaacgcctgctcgcgcaagcgccgcaaaagcgtatcataatcgtattccgtcgtttcttcaaaaattgccgcgtcagctttaaaggcaacgctggttcccttttcctctgtcggtccggtatttttaagcggttccaccgctactccgcgttcaaacctttgataataccgcgcgctcccgtcgcagacctcgacctcaagccactcggacagggcgttgaccacagacgcgcccacgccgtgcagtccgcccgaaaccttatagccgctgccgccgaatttaccgcctgcgtgcagcaccgtaaagacgaccgtaacagccgggatgccaagctttggctggataccaaccgggattccgcgcccattgtcgctgacctttacgatattcccaggcagcaaatcgacttcaatttttgtgcagtgtccagccaatgcttcgtcaatcgagttatcgacgatttcatacaccagatgatgcaggccgcgcggtccggtcgatccaatatacatgccagggcgcttgcgcaccgcctccaggccctccaggacctgtatttgtgaaccgtcgtactcctgctcatccggcacaataccgggattcagctcgttttgatcccccactgtatccactcctttcaggatgctgtttttcatacattggagatgccatctataaacccggcgcgttttttcagcgtcgtagaagaaatctgtgtgatgtagacggttgatttttgtccttcaacacagatcacaaacgattttggcagctcataggacacattgacaacacgtccgccttgttccgattttgcaagaaactcctttgtgattttcgatacggagctgttctccagatcaaaaatcccgacgacatcgccggttcggacaacggtatcctgcccaagatgcaaatacatgctattcctcctgttctttcacgctgtccatcccatggctgctgctggctgcggcgcggccgtcttcgatccgcacagacacgccgctggacaatcccttgaaatcactgccatcacagcttgtcattataatttgccgtccctgtaaatgattgagcaaataatcgcgccgcgctgcgtcaagctcgctcatcacatcgtcgagcagcacaaccggatattcgccgagcgtttcacggatcaactcgcattcggcgagcttgagcgccaacacacagcttcgctgctgtccctgagaaccaaatgcgcgcgcgctctgcccgtcaagcgtcaaatctatatcgtcgcggtgcggtccggctcctgtcattcgtgtgcggatatcctcaccgcggtgtgcccgcagatcctcaagcgcacgctgttcgatttcgctcatcgacgctcctggatcgacagccagagacggcgcataccgcgctccaaacttctcgcgtccgcctgcaagaccaccgtaaatctcctgtgcgcacggcgcaagccgctccagaaacgtcgcgcgcgtttttattacaactgcgccatatgccgccaggcgcgcatcccatatatcgagcgtatcaaacaagcttgtttcatacataatatccttcagaagccggtttcgctgatcaagcacccttgtgtattgattgagaacatgaatgtatttaggcttgatctgacaaatcgacgtatcaataaaacgccgcttttcatgcggcccgttttttacaagcgtcagatgcgcaggcgaaaaaacaacggcacagaactggcccgccagctctgccgcgcttttcaacgggacctcattgagcgcggcggcgcggcgtttttcaatcgtcaaaagcgccttctgttcgcgtccggccgcataaaaaccagcttcaaccgccgcctgcggcgcgccgaagcgcacaagctgcgcatcctttgcgccgcggaagcttttagctcccgtacacatccacactgcttcaataaagtttgtctttccctgaccattgtcgccatagatcacattggcgccgggacagagcgcaagctccagtgatgcaatgttgcggaaatctgtaatacggattcgatcaattctcacgcgcaaacctcgatttcaagctctccaacgtttacaagatcgcccggcctgatctttttgccgcgcattgcgcatagttctccgtttacccgcaccatgccgcctgttatccattccttcgcctgaccgccagtctgtacggcgcccgcaaatttcaaaagcgcgtccagcttgataaacggcgttgtgattgttacctgcatagggacatcctttcgccgcttattctgatttgaggcgcaccggcagcacgaggaacacgaacgcatcgccttcgaccggcatcagcttgatgggggagaggggaccgttaatcagcacgcggatttcgtctccttcgctcgctttaagcgcgtcgagcatatatcggctgttaaaaccgatttccacatcgtcgccgctctgttcgcagcgaatttcatcatacgccttaccgatggccgtggaacacgaaattttaatcagcccttcttcaaacttcatgcgcagagggcttttaatattatctgagatcagcagagacgcgcggtcgatcgcgctgatcaaatcgcgcgtgccgatttttacggtcgtcgctccaccctccggaatggcggcgcgataatcgagaaattcgccctcaagcaggcgcgatacaatacggtagctgcctgtacgaaagatgatatgacgccgcgctacgccaagttcgacatccccttcctcatcgcgcagcagctttgaaacctcggagagcgatttccccggcacgataaaggaaagagtttcgtcaaacgccaccttttcgcggcgcagcgccagacggtaaccgtcaacagatacaaggcacagctcaccacccttaatatcaaagagggaaccagtatgaaccggcttgctgtcgctgacggcaatcgcgaaaagcgtttggctgatcatattttttaaagccgcctgcggaattgaaagctccgtcgtttcagaaacgccaggcagttccggatactccgaagcgggaagcccgagaatggtgtattcggtcatggagccttttacgagcgtcaacatttttgcgtcgcttgagatgctgatttgctcgctgggcatccggcggatcatatcaaggaaaatacgcgcggacaaaacaatttcacctgcttcgcgtacatccgcttcaatctctgttgaaattgccagttcaaggtcgtagccagtaagggaaagcgtattatttttagcgcgaagcaaaacgccttccagcgcagccagcgtatttttggaagaaacagcacgcgaaacgtttgcaaccgcatccactaatagctgcttatcacatattaattgcataaatatctcctttccggcctttttgaaaaaaggcctcggcgaaaaactttagtcggctgtgccgcgaacaatgggataggcattgagcttatcgggctatatcaaaagactgttccttcgtggttcacatgcagtttatgtttccacactcctattttccgtccttattataagaaagtaagtatataaggatcgtagtagtagtaggggacgttgagatgtataaaagcttgcagagtggcttgcagagccaatttagaagctttttttcattggagagtgtcgttgcagaattgtgaaaatctttaaaaagcgcattgatattaacgatgctgtggaaaactggatgttaaatgagaaaaaatgtggaaaacttcgtggaaaacgtggaagacttttcaggttgttttccacattggggaaaatgtggaaaagtagaatgtgaaaaactagctgtcacggatattttttataatatcctcaatcgtttccttataccgcaaatcgttattcatgtttttttcaacctgctgaattgcataaacaattgtactgtgatcgcggccgccgaattcgtcgccgatggtagacatcgacatttgggtgatttcacggacgatataaatagaaatctgacgggccgctgatatctgcgcgctgcgcttgtttgaacggatgtcctgcggcgagatgccgtatgtgcgtcccacctcggaaatgatgcgctcgacagtgacagggaccggctggttgtcgttgaggatgtcacggatcgcattctgtgcgatcataatagaagggtttgttccctgcagcagcttataggctttcagttttttgacagtcccttcaagctggcggatatttgttttaaggcgattggcaatatattcagcgacatcatccggcatctgaatatcgagaagctgcgctttgcgccggatgattgcaatgcgcgtttcaaaatccgggatctgaatatctgccaaaagaccccattcaaagcgtgtgcgcaggcggtcctccaacgttttgatctccttgggcggacggtcggacgcaagtacaatctgcttgtttgattcgtataatgtattaaaggtatggaaaaattcttcctgtgtgctttccttgccgccgatgaattgaatatcgtctacgagcagcacgtcggctttacggtatcgttcgcggaattcagccgtgcgctggtcgcggatggctgtgataatatcattggcaaattcgtcgccctttacatagatgatgttataatttgggcggtttttgcggatttcagcacagatggcgtatagaagatgcgttttgccaagaccggagcctccgtaaataaacagcgggttataggcatttgcggggttggccgcgacagcaagggaggctgcatgtgcaaatttattggaggagccgacgataaacgtatcaaacgtatagtcatattcaccgttgacggccgccgcgtcggaaggcggcggcccggccggtttttcagccggctgcggcgtttcgcaggtaatgatgacatcgaccggaaaacccaacgtcgtttcaaaagccgacttgaggatggaagtatatttttcacggataatgttcattttaaattcggaattaacctgaaggaaagcggccgagccttccaagcgcagaggaatgatatccttgagccacaggttaaaggcgacgtcggagatctgatttttgcagaggtcaaggacaagagcaaataattctgcgaatgaatccataacaggggtactcctcccaataatctgagtggataaccggttgagaacgcagcgggcgtctgtttaaaccggcgctttttacacagtccttcaacggaaccgatatcttttttatcataacacagattcaggattctttcaagtattcaacgggtggctgcatagacattattatatagtatatacttctttcaatgaccgccaggctgcggcgacagccggcaaaaatagccagaggtattgacaaaaacccgtgacatgcggtataatgcttatctgcaaggtaaaaaagaaggaaccgcggggcgccggtgaaaacgcagtgctaaagcggttcttttgcgcatccttgacgaggggaggtttaacgatggtaagaacgtatcagccgaaaaagcttcagagaaaaaaggagcacggtttccgtaaacgtatggcgactcgcaacggacgcaaggttttggcccgcaggcgggcaaagggaagggcgcgcctgacccattaagcgcataaacagacaggcggctgatgaccgacgccgcggatatggccacagcttgcgttgtggcctttatttttatcattgtccgcgccggacggcacgccgcaaggctgcgcgctgttcgctctggaggacagatagcatggcgaaaatccaaacgctgacattgaataaggaatttaaacgggcttattacagaggccgttcctttgctacacctgtgcttgttgtctatgcccttaaaaacaggagcggggaaaaccggctggggctgaccgcaactaaaaaagtgggaaaggctgttaagcgcaaccgagcgcgccgggttatgcgtgaggcgttttatttgattgaacaggagcttgcgcaaggatatgattttgttcttgtcgcgcgcgtcaggacagcgttcgtttccatgcagcaggtgcttgaagcgctgcggcgcgcctgtgaaaagctgggattgttgaggtgaaggcgtttctgcttgcggcgatccgtttttacagaagatatctttcaccgcttaagccgcattctacctgccggttttatccaacgtgttctgaatacgcgctgacggcgatttcccgttttggcgcgctgcgcggaggctggcttgcggtcaaacggattttgaaatgtcatccgtttcatccgggcgggattgatcatgtgcctgagaagctgccgcggcgaactatcaagaaggagaaataaagcagatgtccttaatttatacgatatttggctatccgctcggatggattatgtgggcgtgtttcaaggtccttccgatttatggcgtcgcgcttgtgctgtttactttgattgtgcgcgtctgcctggtgccgctgtcgattaaacagcaaaaatcgatggtaaaaatgcagattttccggccgcgtatggaggaaatacagaaaaaatacgcgaacaaccgtgaaaaaatgaatgaggaaatgatgaagctctatgaggaggagcattacaatccggcctcgggttgtctgcccatgctcattcagatgcccatcctctttggtctttatgacgtgattcagcgcccgatcacgcatctgctgcgtatcagcggtcctgtgatcgatcaggcgactgagatagcggcgacggtgttgaataatgcgaatttggcaaaggattattcgcgccaaatccgtattattgatgcggtgaatacaaatcctgacgccttttccggacttggcgattttgtatcgaaggtgcagacgctcgatctgtcgatcgggccgatcgatttgacgcagcagccgacgtttgcgctgaatctgttgattctgattccgatcttttcatttttaacgtcgctgctcgtttcgtttgtatcgatgcgtcagacggccgatatgagcggaaacgccgctgccgctgccggcatgtctaaaagtatgatgattatgatgcctttgatgtccgcatggatttccttcgtggtgccggcgggacttggcgtgtactggattatttctaatatcctgatggccgttcaaacgtatctgcttaataaatttatgaatcccaaggagcttgcagaaaaagcgcgcaaggaagcagaggagcgcagggaggccgaacggcaggcgaaaatagaggcgaagaaacgcgcgcgtgaacgtggagaaacggatattgagcaggcgctttcccaaaaggaaatcaaccgcctgaagctggctgctgcgcgcaaacgcgacgcggagaaatacggcgagacatatgcagaggtaacggacgacgacctgaaatcataagattacgaaagcggaaaaccgggtgaatcctccaaaacaacgttgcagaaaaaaattctgcagaccgcccggagtatggggcgcaaagagacgatgggtgtacaagcgtcccttaatgggcctgttgacaaagccgccgcagccaaaacagcggcgcttgattccggaatcagttacaaaaaaattgtgaagccccgaagggcatcctgcgttttttgttttatcagccgaaaagtctgctttcattatcggcacggcttggtttgtcaacagcccctatattatcggaggtgtcaaggatgcgtgaggtaataaaagaagcacgcaatgttgaagatgcaatcgaactggcttgtaaagagcttggcgttcagcgcgacgcggtggattttgagattataacattgccgaaacgcggctttctcggcttgcgcaatacgcccgcgcgggtacgtgtttttgtcgaagaaccggagcctgtttcggaaataaagaaggacaggcagccggcgcccaaagaggtgcaggcggcgcctacaaaggaacagagggcggacagagcgtcgcagtctgaaaagaagccgcagaagtctgttccgaaacgtgagccgaaacgtgaacagccggcacgcgcacaagttgagactgcgaagaagcaggataaaaatgaacatgttgggatggaaaagcaggaaaaggcggctcaaacaatcacgtttgtcgaagttgagaaggttgaagggaaggcgcgcgttgcggctgaatatgtgcgcggtgttttaaatgcaatggaaattgacgctgaattaagcgttgcgagaacggaaaatggcgtggttctgcgtctgaccggggatggactgggcgtgatcattgggcgccgcggagaaacgcttgacgcgctgcaatatctttccagccttgtagccaaccgggaggaaggagattacatccgtgtaacgatcgattctggaaattatcgtgaaaaacgtgagaggacgcttgagcagctagcgcaaaagcttgccgcaggcgttttgcgctatggccgtccttcaacgcttgagccgatgaatccttatgaacgcaggattatccattcgactgttgcgagaatagagggtgttacctcgtcgtcgacaggagaggaaccgaatcgtcgtgttgtgatatcgccgataaatccgcgtccgctgcagggcggcggaaggggcggccggggaggacgtggacgtgcgggagcaaatcgtacggcgcgtcgtgacgaacgtgtgccgcgcgatggcgagcattcggagcagaggagtgaacgcgcgccgcgcagggaacgcggtcctcgacgcgacgaccgcgcgacgcgtggggagacggttaagccgacatcgacagaggtagaccgcgcttatgctgccgaattggagcgcgaaggcgcattggaacgccctgcacagccaataccaaggacgcagcagaagcctgtccgccagcaggcgcgccatgagggtgatgatctgccgttgtatggaaagattgatctttaagtgtttgatgatcgtgggggaggatgtttcacgtgaaacatcctcccctttgtcaataaacgtaaaacaaggaatgcagctttatgatgtttttgttgactgcctttatcggtgtagtggaggattgttatgggtgaaatcgatacgattgcggcgattgcaacgccgcttggaacaggtggaattggaatcgtcagaatttcgggaccggatgcttttggtacggctgaaagaatcgtgcgcttagcgaaaggcgggagggtttcctcactcgcgggctatacctgcgcctatggtctggccgctgatcaggagggaccgattgacgaagtgatcgtcactgtttttcgtgggccgcatagctatacaggtgaggataccgtcgagttatccgcccatggaggcgtctatttaatgaatcgtcttttgaatgcctgttgtaagaatggcgcccgtcctgctctggcgggagaatttacgaaacgggcgttcctaaatggaaaacttgatctgacgcaggctgaggcggtgatcgatctaatctctgcgcacggcggacaggcggcgcgcgcggctctttcggcgcgcggcggcgcgctgtatcgatgtgtaggggagattgcggacaggctgacctattttgcggcgcatctgtctgcttggattgattatccagaggaagaaatagaagcggtcgatccgaacgctttgcagagtgatttggcagagtgccttcaatcgctcgacagtctggctggatcgtatgaaacgggacggcttgtgcgcgagggtatcgaaactgtgattgtgggtcggccaaatgtgggaaaatcatcgttgatgaatttgatgacaggcgtgaagcggagtattgtctcggatattcctgggacaacgcgcgatcttgtcagcgatacggttttatgcggcggttttgtttttcatctcacagatacggctggaattcgaaagccggatgatccaatcgagcaggagggcgtcggcttggcgcttgaacagatagagagggcgcagcttgtattggccgtgtttgacggctcggagccgttgacgggggatgaccggcgcgttatggaagcttgccgtggtttgaacgcgcttgccctggtcaataaggccgatttgacgcaggtgctcgatgcacaagcctttgcatcggattttaagcgtgtgcttttgatttcggcgcatgacacgaatatcataaagcctttgacggaggcattgactgaaatggtggggttgggcgcctttgacagttccgctgcgatagtagcaaatacgcgtcagcgagcggcggtgatggctgccgccggggagctgcgggaggcggtagaggctttggaaaacggtgtttcctacgatgcggttgctgtttgtatcgagcgcgcgctcgatgcgctgttggaattgacaggaaagcgtgcgtcacaggcggttgttgattctgtgttttcacggttttgtgtaggaaagtgacatgcagaagggggaatcatggatggattatgaagcgggaacgtatgatattgcggttattggaggcggacatgcaggtatagaggccgccttagctgctgcgcggcttggcgcgcatacggtgctgtttaccatgtcgcttgatgcaatcggaaatatgccctgtaatccatcgatcggtggaacggcgaaagggcatcttgtgcgtgagattgacgcgcttggcggtgagatgggacgtgctgctgatgcgacaatgcttcaaagccgtatgcttaacagggggaagggtccggcggtccattcactgcgcgcacagacggaccgaaaggattatcaccggtatatgaagtatgcggtggagaatcaggatcgactcgatgtaatacaggcggaaatagtggatatcagggcgtccgacggtgcggttgagtctgttgtgacagcgttgggtgcgctttatcatgcgcgcgcggttattctttgtacaggtacttatttacgcgggcgcatttttgttggagagtatacagcgcaaagcgggcctgacggtttgcatgcagcggatcaactgaccgcggcgcttgagcgtcttggtttgccgctgcgccgttttaaaacaggaacacccgcgcgcgccgaccgccggtcgattgattttcaattgctggaggtacaggagggtgacgatccgattacacccttttccttcgaaacggacgggggaatgctgaaaaacagagcggtttgtcatatcgcatatacaaatgaacagacgcatcgcgttatactggaaaacctgcaccgttcgccgctttacagcggacagatcgaagggattgggccgcgctattgtccaagtatcgaggataaggttgttcgtttttctgataagccgcgccatcagattttcattgaaccgatggggcttgatacgaatgaggtttatttgcagggtatgtcttcgtccttgccggaggaagtacaggtgaagctgtacaggacagtgaagggctttgaacagatacgcattatgcgcaacgcctatgcaatcgaatatgattgccttgatccaacctgtttgcaggcgacgctggaatgcaaggcagtgcgcgggctttatggtgcgggccagttcaacggcacctccggctatgaggaagcggccgcgcaaggtttgatcgctggtatcaacgccgcgcgtgccgtacagggaaaaacgccgcttgtgcttgaccgtgcgagcagttatattgggaccttgattgatgatcttgttgtgaaaggctgcaacgatccatacagaatgatgacatcacgatcggaataccgtttgattttaagacaggacaacgcggacatgcgtttgacgccgattggatatgaaatcggtttgattggggcggagcgctgggcagcgttcctgaaaaagcgcgaactggtggaaggggagataaggcgtctgcgtgcggtgcatacagcgccaagtgaaaaattaaatgcgttgcttgtttcacgtgaaacatcgcccattgcaacggggatacgtctttgtgagctgctcaaacggcctcagctttcctatgcatcgcttgcaccctttgatccagagcgccctgaattgcccgcgcaggtttgcgaacaggtggaaataacaattaaatatgaagggtatatcaagaagcagcttgaacaggtggagcagatgcggcgtttggagggaaagcagcttccaggcgatctggattatcaatcgatcggcgggctgcggctggaagccgtcgagaaattgacgcgcctgcggccattgaacatcgggcaggcatcgcgcatcagcggcgtcagcccggcagatgtgtctgtgctgttgatttggctcagtcagcaccatgcatccgcacagaatgcgggggaggagaataaatgattgaacaggatatgttaaaagaatatgcggctggtttcggtgtaacgcttgacgctgcgcagttggatgcttttgagcgatatgcggtgctgttggttgaatggaatgcaaaaatgaatctgacggcgatcactgaaccgcaggaaattgtgatcaagcattttatcgacagcctgtcgctgctgtcagtttgtcccatcccgcagggggcgcggctcgtcgatgtcggaacaggagcgggctttccgtccgtcccgctgaaaattgcacgtccggacctgcatttgacgctgctggacagcctgaataaacggattacattcctgcaagaactgtcgcaggcgctgggccaggacaatgaatgtattcatgcacgcgcggaggaggcgggacgatgtccgggccatcgagaaaaatatgatatggctgtttcgcgcgctgtcgcacggctgtatgaattgagcgaatattgcctgccgtttgtcagggtcgggggaatatttgccgcgtataaggggaatgattgtgacggggaatgtgcccaagccaggcgcgccgttcaactgctgggtggggagcaggaagcggtcaagcgccttgggctgcctgatgggagcggccgggcgattgtgctgataaaaaaaagatcgcagacatcgacaaaatatccaagaccacatgctaaaatagcaaaaaatccgctggtgtaatgaaaacaccggcggattttgctattttctgcgatgaaaagtgctggaaatttggaatatttcatggtatgatgcaggcatggacaagataaagaaaggatgcggggagcatgaagttttcaaagcaacggaccgtcaaccgtgttgttctgatcgatgtcgaccgcatcgtgcgcagcccctatcaaccgcggcgtcaatttgaaccgcgcgccatgcaggaactggcagacagcattgcacagagcggtctgctccagcctgtgacagtgcgtgcggttggaagcggctatgaactgatcgcgggcgaacggcgcttgatggcgtgccgcatgaatgggattgataaaatccccgcaattgtggaacagtttgataatgaaaaatcggccgtctttgcgctgattgaaaatttacagcgcaaagacctcaactattttgaggaagcgcagggaatccgccggctgatggagctgtgcgatatgacgcagcagcaggtggcaaaacggttgggaaaagcgcagtctacgattgctaacaagctgcggctgctcaatttcagcgaagaactgcgcaggcggatgcttgatgcaggactgacagagcgccatgcaagggcgctgctgaagctggaaagcgatcaacagatcgaagccgctttggaaacgattacgcatgaacgcctgaatgtcggtgaaacggaacggttgattgagacaatgctgactgcggcgccggaacctgcgcctgcaaagacggagcagaaagcgaccaagctgtttgtattgaaggactttcgtatcttcatgaatacgatcacaaaagcggtttcgacgatgaagctggctgggatcgatattgatacagaaaaatttgaggacgaggaatttatcaattatacgatgcgcatcccaaaaaagagtgcctaccgtccacacagcgcataatagaacaacaaagaaggccatccgccacaggccgcccgcagggaggacagcgcccgaaaaagcggctgtgtggtttggtaaaataaatacacgtttccctgcaacacaagccgcccaaacgggcggctttgttgcgtcttaaaagcggattgaaaaaatgaagcaaagccgcgatgtttcacgtgaaacataaaagggtataaaggtccggttcggcggtggggtctgtaattggcgccgcggccgaatgcgcaggacaaaaggcttttctttgagaaatgaatgtggtataatatgcgcagtgcaaacgacaaagccgtttgcagccgccatatggcggcaaacgctgcaaagcagcggattgcgcatgttacaccacagccaaaaccggctttgccggtttccctgccgctttgcggcaggcaagcccgaatgggcttgttgctgtggtataatcataaggcaatccatgttgatggaaagatattcgcttttaaggggtatcggagggaaaaaatgggcaagataatcgcggtggcaaatcagaaaggcggtgtcggcaagacgacgaccgccgtcaatttaactgcggcgcttggcgcgcgcggataccgcgcgctattggtcgatgtggacccgcagggaaattccacatcgggtcttggcgtcaataaacgcggcttggcctgctcgacatatgagctgcttgtttccgcggccggggctgaacaggcgctccagcatacgccgtttcaaaacgtggacgtacttccctccaatatttcactggcaggcgcggaaattgaactggttgagctggataaccgtgcgatgcggctgaaaacggcgcttctgaggattcgggatcaatatgattttatcttgattgattgcccgccgtcgcttggaatcatcactttaaacgccttcgcggcggcaaattctctgttgattccgattcaatgcgaatattacgccctggaaggactttcgcagctcattgcaacgctgcggcaggtaaagcggctttataatcccgatatagatatcgagggcgtgctgctcacaatgtatgacagccggcttaatttgacggtacaggttgtagcggagctgaaaaaatactttccacagaagatttaccatacagtcataccgcggaatgtgcgcttgtctgaagcgcccagttttggccagccggttttgtattatgaccgttcgtcaaagggcagcgccgcctatgaggagctggccgatgaattcttgaaaaagaacaggattaaaagggggaactgatttggcaaaagcgaaaggcggactgggcaagggtttggaggcgctgtttgccgacaacagcacggacagcgcatccgtttcatcgctggctgtcagcgaaattgaaccaaaccgcggccagccgcgccgccattttgacgaggcggcgcttgccgagctggccgattctatccggcagtatggcgttttgcagccgcttgtcgtccgtccgatggaatcgggaggctatcagcttgtcgcgggtgagcggcggtggcgtgctgcgcgtatggcgggactgtcgcaggtgccggtggtgatccgggaattgagcgacagtgaaacaatggagcttgcgcttattgaaaatctgcagcgcgaggatctcaatccaattgaagaagcggccggataccgggagctgatggaaacgtttggattgacccaggaacaggtgtccgagcgcgtgggcaaatcgaggccggtgattacgaatgcgatgcgtctgcttggtttgccggacgccgtgcgggcgctcgtaagccagggggagctgtcggcaggacacgcgcgcgcgctgctcggccttgaaaatgaggctgtaatctgtgcgctggcggaggaaatcattaaaaagggttggtctgtcaggcaaacggaagcctttgtcaagcgtcagaaacaggcggaaaaggcggaggaggaagcgccgcgcaccgcatgggacaacagtacgttcgcggaggtgcagcttgccttgatgcagagcctttcacgcaaggtgcgtgtagaatgcaaaaagggtgaaaaaaaaggaaggctagtgatcgagttttatgacgagcaggacctaaagagcctggcggcgttgttcgacaggggacaggggtaagcaagagacgataaattgacggcggctgccccattgttcgcggcgcagccggctaaagttttttggcatacctttttttcaaaaaaggtatgaagtttttcgccgagcttttttaaaaaagcgggaaaggggaagaaagatgctcgatattaaatttgtccgggctaatccggatgcagtcagggaaaatatcagaaaaaaattccaggaggaaaaactgccgctggtcgacgaagtacttgaacgcgaccagaagttccgggagacaaagacgcgctgcgataatctgcgcgcacagcgcaataccatcagcaaacaaatcggcggattgatgggcaagggtctgcgcgaggaggccgaacaggccaaagcgcaggtaactgcgatggcaaaagagcttgaggagcttgaggagcttgaaacgaagcttgaagcagagatccgcgagcggatgatggtgatccccaatatcatcgatccatctgtgccgatcggccgggacgacagcgagaatgttgagattgaacgctttggagatccgacagttccaccttttgaggtgccttatcatgtggagatcatggagcggctcaacgggatcgatcttgacagcgcgcgtaaaacaagcggcaatggcttttattatttgtgtggagatattgcgcgtctgcattcagcgattttgtcctatgcgcgcgactttatgattgaccgcggcttcacttattatatcccgccgtttatgatccgcagcaatgttgtcaacggtgtgatgagctttgccgagatggaaaacatgatgtacaagattgaaggggaggacctctatctgatcggcacaagcgagcattcaatgatcggcaaatttatcgatactatgcttgatgaggacaagctcccgcagacgcttacaagctattcgccgtgtttccgcaaggaggtcggcgcgcatggcatcgaagaacgcggcgtctaccgcatccaccagtttgaaaaacaggagatgattgtcgtctgcaagcccgaggacagcgccgcctggtacgacaagctttggagaaatacggttgacttcttccgctcgcttgatatcccggtgcgcacgcttgaatgctgttccggtgatttggctgatttgaaagtcaaaagcgtcgatgtagaggcttggtcgccgcgtcagaaaaagtattttgaggttggaagctgttcaaatcttggcgacgcccaggcgcggcgcttgggtatccgcgtcaggaataaagaaaaaggcaactactttgcgcatacgctgaacaacacggttgttgcgccgccgcgtatgctgatcgcatttttggagaacaacctgaacgacgatggatctgtacgcatcccgcagccgctgcgcatgtatatgggcggtaaggacgcgattcggccataaaaggatgcaatgcgtcagtgcagaaaaataaagcaaaccatatgtgaaataaaagccgggtctgtctgaaaaggcaggcctggcctccaggaatgatgagaggcggcgtatcgcttgatccgtgagtttgaaaaatggatagaagtaaccgagcctgaatgcgatctaacgcatcgtatgagcttatcaaatattatgcgccatacgcagcagatgggaagcgatcatatcgcgcgggaagggattacctatgaacggatgcagcaggacggcatggtgtttcttgtcaataagatgctgattacaatcaagcggcggccggtttatgctgaacgcctgcgcctggtcactgtcccgcgcgtgcctaagggcgcgcagtttatccgggacacctactttgataccgaacaaggggaacggcttgtcgagacaagcatttcctggattctggccgatccgcgcacacaccgcatcctgcggcctgcggcgtttgatatctatggacttgagatgtttccaaacgacggggagtatatcaccgcgtaccggatcaaaaaaccaaatgcagcgggcgtgcgccatatgcgccaggtaaagtacagcgatcttgattcgaacagtcatgtcaacaatgcggtttatgcggatattgtctgcgatacgctgccgttggattggcttgttgaacgtgaaattaaaaagttcggtatcatgtatcaaaaagaggcgctcgcgggacaggtgatcgagcttgataccgcacagatttcgcaaagcgcatattatgtgggcggtatggccggcggcgggcgctgttttgaagcggaaataaattttacagaaaagctgcaaagctattgacaaaataaagattctacggtataatttagtacgctcgctcatataataagggagcagaaaatggcggtatagctcagttggctagagcattcggttcatacccgaagtgtcaccggttcgaatccagttaccgctaccagacgggcctcactgctgcgtgaggcccaatgtttccggcctgttcgtcaagtggttaagacaccgccctttcacggcgggttcacgggttcgaatcccgtacaggtcaccaaaaacccccggttctatatggaaccgggggcttttctgtattaagcgtcaaatgaaatgaaaagggagagaggcagcgcatggacgatttaattgcgtacatccattttatccaggaggttgaaggcctcaaatgcatgacgcgtacagcttggacaagcacaggccggcgtgaaagtacagcggagcattcctggaggctggcgctgctggccgggctgctgctgcccgcgtatcctggacttgacgcgcggcgggtgctgatgctctgtctggtgcacgatctgggcgaggtgtacgagggcgatatatctgcggcactgcggccggaccaggaggaaaaggagcggcaggagcgtgcggccgtcaagcgggcggcagcgtctctgccggagaaggccggcctggaactgtgcaagctttgggaggagtacaacgcctgcgaaacgccggaggcgcgtttggtgaaggcgctggataaggccgagacaatattgcagcataaccagggcgccaatccgcctgaatttgattatgccttcaatttggagtatggtaaaaaatattttgaatacgacccgctgctccggaatctgcgcgcgctcctggatgaacagacacgcgaaagggtgttgaaacaggaacagcgatgctgaaacgtaaacgcccgcgctgccaaaaggcagcgcgggcgtttgaaatgcgggggaggggagcgcaaatcacgatttttgcgcacgcttttttttcatgacaatcagaaaatccggaaggcggaagatttcaaggctggcggaacggtcaaggttgcggatatggtggcgcatatgtccctccgcacgcgttgatatgacaagatcacatttgtcatcgccccgctggagaatgctttgacgaatgttgatcagcgaaattttatcataagaaaagactactgtgtgtaaatgatagagctttgaataacgtaatgtataataattttcgcagcatgagacgccggatgaagcgaaatcgagcagcctgacgcccaaaaaccaaaaggccggcagacagagcataaagcctgcaaaacgaatgatttccacccagcttggcagaagccagcaggcggcaatcgtaccagcagggatcagaaggcagggccagagcggttcgatgataaatttaaagattgcgccgccatttggcttgagtgtacgctgcgaaaggcggtattccgggagcagcaaggccaggcgcttttgcgtgcgctttttggaggagaaagggatgacagccgcgatatcggattttttgtccttggcgaaaccgatcgcgttgatatagacggaatatagacgcagaaggcgcgttgtcaggctttggcggatatcgataaagctcacgtcgtcgcgccgcagagaatattccttttggacgagcacgccgccgctgacatggagggtgttttccgagcggcagacaaacaggtttttgacctggagcaggctgatacagaaggcgacaagccatccgcacaacaacaaaagcgcggcgcccgcgaagataggcggaagaccaaaggcgatccggcgggacagctcctcgaaggttgtaaccaggataccggacagctcctcgccgagaatttgccccatatgtgaaaaaaatgttgcgatgaaaacaatgccgatgaaggaattagaggttaaaagcgaaagcagcacaagctcatagaggtgcggccggtcctgcgcgggggcgccgtccgaatccatggccgggggagcggcccgcagcgaagaaatgcggtcggcttcacgcgaccagacataaaaggcggcgtcgggactgcgcggatcgcctgcaatggtatcgatgcgtatacgggcaatgcgaaaggggcgcagccaaaagggacgtattacagaaagggttgaaatacggtcctgagggatgtaaaattcactgcgaaaaaatatacccgttgcaatatatacgccattaatatccatatggtattgaaaatgctcccacttttggtaggccagaataataatcagggctacaatcagaatatcaaaccaggcgccgcgcacccatgaaaagatatcgcctgtcagcgcgctgataaagccgcgcgccaaggggataatcagaagaaacaggaatcgatataaaaaggtgagaatggaaaaagggtgcgcatggatagcgcgcgcgcgaacatcagacatcaccggctcctccttcctgggcggcgctgtgcgggcggcccggagtcagaagcgtctgcagctcccgcgcgtcctgcggggccagacccggaatgtagacacggcctccagccgcgtagacgaatagggaagtgacgccgaacaggcgctccaacggggttgaaaagacagaggtatactggatgcttgtaaatggaacggctttcacacgcgtataaatgacgccgcagtacacaagcaggcaatgcgcgttcgtgccataagccagcttgcggtattttatcggataatagaatatgtaaaagtacagaaaggcgcacatccaggcagccgtaaaaagccaccacagccaattgacgcggggcgaaaaccatgcggtcaaaaacgagggcacgagcgcggccgccaaaagccgcagccgccaaacggtcaggatatgcaggtcaggtttttttaatgtcacaaacggccgcctttctaccacatcggttttaatggtatatcctctattatataggaaaacacagggaaaaaacagagtatttttgcagaatattaaactaatagtatagactataatcaattataccattttagcgcccggacagatcgtaaaaacctgaccgggcgcctgtattttggaaggctgatgggaacagcttctagctgcaaaagagatgagcgccaatgcgtttgatcaccggacgtgtccgaatccatttgtttgacgtcttgtcgggattgtaataatagagcgcgccgcccgaaggatcggagccggccaaagcttcgcgagccgcttttttggctgattctgcgaccgcttcgttgatctggccgtcggtgatcgcggtgaatgcgcctggttgatagacaacgcccgaaagcgtgtcggggaaggagggatgctccacacggttgagcacgaccgcccccacagcgacctgtccctcaaatggttcgccgcgcgcctccgctgaaatgatgtttgcaagcagggcgatatcgctgctggaataaccgccgctgccgcctgtctgctgcgaggattgaatccccattgcttttagggtagcgttgccggcgattccgtcaactgtcagtccgtttttgcgctgaaacgacataactgcctttttcgtttctacaccgaagattccatccacttcgcctgtataatagccccagtttttcagacgctgctgaatttggcgcacctcattgccgcgcgagccagtcttggaaagcacgctttccgtttgaccgccgatgcgcgccatataaagaatcatcgcgccgagcagcagcagcgcaaaggcaagcgataccgtgcggaccacaatgacagcacgcgggatataaccgctttgtttggacatgaaaatgcctcctttgagtggcctgatagttgcagtatgtgcggtgacgccgtctttatacatatgtaaataccgcgtaaaatgtagctttccaagaaatttcgactttttttaaaaaaatgctaaaaagtagttgacaagcatggcagagtgtggtattataacaaagctgtctcgtgcgaacaacacaaacgccgatcaaacgacagcgcacagcaccttgaaaaatgaacaacgagaaggaaagaaccgaagtgaaaccggaagggcttgagaaagtccggaaggggaagctaaggaccctggaaacgaaattgagtgcatccgttgaagaaacggacgtacaagcgaaaccagcaaaggaaacgaagctggatcgtctttgattaaagattggaagctgcccaacggctcgccgcttgcgcggcaaccgccttttgatgggcaattataccatgccgcttcgcggactcggcctaatcagggtaagattttagagaggaattttgcatgaacttatttgtttcaatggcgttttgcatcaccacctccattccagccacctgtattgcgcttatctatgcggagccgtttccgaaaaagcgggggcactattgttttttggctatgtgtatcctgtccgcgctttggaatatcggatacgcgggaatgttcatttcacaaaacccggattatacccgcggcttctatcggtttgtgctgatcggctcgctttttatttttccgctgatgttcaagctgatggaggagatcagtgaacggcggtattgtccgcttcaacaatttgaaatttacatgaccgcgcttgccgctatgctgtttgtgattgtggcgcgcagagaaaacctgatgctcgtgcatttggattggggcgggcttgatttctgtgtgcctcaggcgggtggggcgactgtcctgctcatcgcctattatacaattatcggtttggtgtttttatactcgctgtatcaatgggtcaaggcggagggagaaaagcggcgtgtgcgcgagcaggctggttggctgtgcctgtgtgttttcgtctgctttttggcactggcgctggaatacggcagcctgtttgtcggaatgccgtcgattccgatcgggggcatttcgaacctgctgttgcttgtaatcacgtttatcatggtccggcgttacaatacaatccagatcaatacgcataattttgctgaatatatctattcctcaaccaaaacgccgatcctgatttttgataatgaaggccggcttgcactggccaataaatgtacgcctctttttttcgatctgcctgccggcgcgctgatggggcgaaggccggaggatttgttcctgcgcgtaccggccgacggcgtgggggagacgcatagtgattcccctgtgcagatgacacggttcaactcggtttgccgcttcaataagaagccgtgtgatatcacagtgacaaatgtatacgacgcatacagcgaagtaattggaacgatctatgtggtgtacgatatgactgagaatatgcgccgtattcagctgttggaccgtatgcggcgcgcagaagttgaatccaaccgcttaaaaagcacgtttctggcgaatatgagccatgagatccgcacgccgatcaatgctgtgataggcatgagcgaaattctgatgcgcaagaagctgccagacgacctgcgtgccgacgtcggcgtcatacacagcgccgggcagggacttttggcaattatcagcgaaatacttgacttttcaaaaattgaatcgggcaagttcgaattgatagagacggaatatatgctgccggcgctggtcgaaacggttgtacatattatcggcgtgcgcttttccaaaaagccggtatgcctgttgatcgatatcgaacccgatacgccgatcgggctgtttggggataaccagcgcgtccagcagatcctgctcaatcttctgagcaatgcggagaagtttacgcagtccggttatgtccgtttgtattggagatgggaacatgcgggcgaggatatggtgcggatgattatttctgtcgaggataccggcagcggaatccgcccggagaatcttgaaaagattttcgcgcagtaccagcaggtggatgcaaaatccaaccgcgcgcttgtcggcacggggcttggccttgcaatcgggcgcgagatggcgcgcatgatgggcggcgatatcactgttgagagcgaatacggaaaaggctctgtgtttacagtcacgtttctgcaaaagattctggacaatcgccccgtttcctatatgcccgagggcgtgcatgccaacgtgttgatctgtggagaaatcagatgcgtaaagaagtctattgaattttactttccgcgccttggcgtggattatacgctttgcacttcccccatggaagccatgcgctttgatccaaagacgtatacccacgtgatggcgcctgcggccgagatacgcgctctgcgcgcggtggacggatgggcgcacatccggttcatacagattcttgaggcgacggaatatgttgaaacgctcgacggcgacgattgcatccatctgcctctgcttaaccgaaggattgtacgcgccctgtttggagaggataaagccgcgcctgatatcgtatgggagccggagcggatggaaaatgtacgcgtgttgattgtagacgacagtcctgtcaatctccaggtcgcggccggtctgctggagccgtatcacatggcggtcgatctggccgcgagcggagctgaagcgattgaactggcaaaaaagaatttttacgatctggtgatgctcgatcacatgatgcctgaaatggacggtgtggaaacggcggagcgcctgcgcgcgttgcctgattatggcagagtaccgattgttgctctcactgcgaacgctacaaacacagcgcgcaaaatgttccttgaaaacggtttcgacgattttctggctaaaccgatcaatctcctgcagcttgatcttctgctgaaaaagtgggtcggctccagactcagtgacccggttgcggttgccgcgccgccgctcgatatgagcggcggcgaaggattgcaggagcgcaatccttcgcttgatatccctgttctgcttgacacacaggcggggatcgatgcgttggggggcaacctgccagtctatacacatgtgattgatgcgttctgcgtggatgccgtacagcgtgccgatgaactggaaaagctggcggatagcaacctccgggattttacaatttcggtgcacgcactcaaaagcgcctgccgttcaattggcggcgcgcttgccgctgatgaagccgcgcgcctggagcaggcaggcaaggagggcgatgaagcttatatagggagcgcattgccgtcgtttctggcgcatttgcgcgcgttgattaccgaggcgcgcaaatggcttgaggagaacaaggcgcaggaggcacccgggaggcaggcgggattaagcagcgcggaagaaatccgcgggaagctggcgtccctgcgccgggcgtgtgaacgcgctgaaatcaaccgcgcggagaagctcgcggacgagctgttggcggagatttgtgatgaacggatacacttggcggttaaggctgtgcgtgcatcgcttggacaatttgactatatccaggccgtcgatcagatcgaccggcttctgaaggaggaaaactatgcctaaaattatgattgttgacgacgatatcaccagcctgagcatggctcgggcgattctggaaagcgagtatacgacgattccggttcgctcgggttatgaggcgttgcgcctgctggcggccggagccgagccgccggatctgatcctgcttgatatcaatatgccggtggtaagcggctatgaggtgctggagaagctcaaggaggacccgaagctgcgcgaaatcccggtggtatttgtaagcggtgaggacgcttacagcaatgaggtggagggtttctcaagcggcgtcaaggattatatttccaagccttatatcgcaagcacgctgctttcacgtgtgcgccatcatctgtcggaatgtgaacagcagacgcgcctgatcgaacagatggacctgctcacagaggagaagctcggcgagctgatgaatctgtttgacacgctgaccaatgcgatggcatatttaaacagccgccgctgcccgcagctttcctggcattccaagcgcgtttcccgttatatgcgcatcctggccaccgcagtggcggccagccagggcggcctttccgcaggcgatatcgacgcggtatcgcgctgcgcggccctgcatgatatgggactgctggcgcttgccgacagcgatttggagaaatacaagaatgtcgagcttgcgcgcacgcgcggctcgggcgacccacaggcgcctgtggcggcggaaatagaattttatacaaaacatacggttgccggacgcgattcgctccgtgtgtttatggaggatcatccgaacaatctttatctgacgtacaccttggaaatggtgacgcatcaccatgaatggtggaacggcaaaggcgcgccggatggtctggagggcgaagcgatcccgttgtcggcgcggatgatggctattgtggataactatgacatcattacggcgcgccgtgcctataagtttgaatatacgcatgaggatgccgttatttccatacgacgcaacgcgggcgcccggttcgatcccgcgcttgtggagatctttttgagcgttgaggaccagatgaaggcgtgtcttgggcgcattgtccaaaatatttaaataacgcccggaaggctatagccttccgggcgttttaaagtcagatttaaaagcagttggcgccgggataacgcgcggctgcgccaagcgactgttcaatgcgcagcaggcggttgtatttggcgacgcgttcgctgcggctcggcgcgccggttttgatctgccctgtgcacagcgcgacggccagatcggcgatggtcgtgtcctctgtctctccggagcggtgcgagacgatcgcggtatagcccgcgcggcgcgccattttaatcgcgtccattgtttcagtgagcgagccgatctgattgagcttgatgaggatcgaattggcgcaatgctcctcgatgccgcgcgcgaggcgctgcgtattcgtgacgaaaaagtcgtcgcccacaagctgcatgccgctcccaagctgcgcggtcaatgttttccagccggcccagtcctcctcgccgagcgcgtcctcgatcgaacgaatcgggtattttttgcaaagatcctcccaataggccgtcagctccgcggcggtcaggcgtgtgcggcgttttggaaggaaatatccgttttcatcggcccattcgctggaagccgcgtcaattgcgagaacaaagtcgtcgtatggcttatagccggcctgctcgatggcgcgcagcagcacccgtacagcgtcctcgtcgctggagagatcgggcgcatagccgccttcatccccgacggcggtcgaatggccgtcgcttttcaggatgccggcgagcgtgtgaaaaacctctgcgcaccagcgaagtccttcggaaaatgacggcgcgccgaccggcataatcatgaattcctggatatcgatgttgttggccgcgtgcgcgccgccgttgaggacgttcatcatcggtacaggcagcgtgtcggccgccgcgccgcccagaaagcgatagagcggcagaccgtatgcggcggcggccgcatgggccgccgccagcgagacggccaaaatcgcattggcgcccaagcgcgatttgtcggacgtgccgtcgagcgcgatcattgcgcggtcaacggcggcggtatcgcacgcgtccatgccggcaagcgtgtcgcaaagctcgctgtcgatgtgcgaaacggctttgcgcacacctttgccgccgaagcgggccttatcgccgtcgcgcagttcgagcgcctcaaattttccggtggaagcgccgctgggcacggctgctgtcccgcaagcgccgttttcaagctctacgacggcttcgaccgtcgggttgccgcgcgaatcgataatctcgcgcccgtatatttttttgatctgtgttttcataatacctccgatgcggggcggcctgtttggccgcagcctgtttttattgatagtatgggcaaacggcgggcgcttatgtttgcatggggaaaggccgccgcaaaaatcccgtcgaatacagacggcgcgcggcacaaaggccgcgcgccgtccggtctgttttatagaaaatggattgataagcgcaaacggcccggacgattgcaaaggtgtgtcagaatccggccagaccgcttccaagcgcccggcagtcggcaaggccgctgtcatcgggcgtttcgttgatcatcaggccctcgccgttaaagagctgtgcgcccgcgccggtcacacggtcctgccaatcgcgcatccactggccgtcgccccatccgtaggagccgaacagggccacctttttgccggagagcttcggttccagctcggtaaagaacggctcgaactccgcctcctcaagcacttcggcgcccatggccgggcagccgagcgccagacgaggatactctgcggcctgatcggccgtgatttctgaaacagtaaaaatctgcgcgtccgcgccgccggcgcgcgcgccttccaggactgcttcggccatggcctgcgtgttgccggtttggctccaatagatgactgcgagtttttccattgtggttgacctccttgattgatgactgactgtattgggtttgcttacgcggcagaaaatagctgcacgatcgattttccggccgccacgcggcggcacagggcctcccggcagcgattgaaacggacaaagagggcgcgggcttcctcctcgttgccgtaaaccttccaatagccgctgaacttataatttttgccgccgtcccgcaaaaatccttccacatccgcgagcggataaccgagaatgacgcctgcttcgtgcggaaagctgccggcttgcgacaggcgcgctccaaaatggataagcgtggcctccaggccgccggacgggtagccggcacgctttaaaaatgcgcgggcgtcaggctgcgcgaggtggcgttcaagcagtgcgcgccggtatacaagcagcagcacgcgtccgctgcaccggcataccggcctgaaatacaggccgcggggattgagctgacggttgagtgcgcgcagctcccgatcgagcgagggataacgcgcgagatcacagcagatcaggttggacggcttgatgccggcgagcgcgggcgcgcagtgaaacgccagcgtatgctccaaagaaccgttcataggaacgcctgcctttctgtttgatcatcgttagtttatgcgttgtgccctcaaataaacagcgtccgcggcggtgtggcggcgcaaaatctgatagttagcaataactaacttgttgccaatcgtatcatccaaactcacgtttgtcaagggggagacaagcaaaaagtttggatcgcttgtttgggacacactttttttatcaaactcaaaaaaagagggccaatcccattgacaaaataggttagcggtggtaaactaacaggcggtaagaggttagttcattctaacctgtttttacagcgcaatagttagcgaattctaactttggagggtggttaaaatcatgccgcttacgatggcccgttcgggcgaagcgattacgatccgcgcggtccgcgggaaggatgaaacccgccgctttctggaaagcctcggctttgtggagggcggctctgtcaccgttgtatcggagatggggggcaatctgatcgtcaatgtaaaggatacgcgcgttgcgctcagcaaaagcatggccaataggattatggtgtgagggggtacagcatgagaacactgaaggaagccaaatgcggcgagacagtcaccgtcacaaagcttggcggagagggcgcgctcaagcgccggattatggatatgggcattacaaagggcacgtctattttcgtgcggaaagtggcgcctctgggcgacccggtcgaggtgacggtgcgcggctatgagttatcgctgcgccggggcgacgcggagaatattctcgtcgattagagggctgcttgaaaaatcagaattcccgtcttttcctgtaaacagcggcgaatgctgcgttaaaaagcctcggaatccggaagggttccagtgttttttgccttgttttctcccgttgtctgcgaaaaatccggtaattcttttattatcaaacaagccctaaagaggacttcggcgtctgcccggataaccggcgctggcgctgctgcaatgatctgcaaacagccgagggccggtcagccggccgcccgacttcaaaggccgcatggcggccagcgggaggaccccgcagaggaggtaatcaggaatgtcaatcaagatcgcgctcgcaggcaatccaaactgcggcaaaacaacgatgttcaacgatctgacaggatcgtcgcagtatgtcggcaactggcccggcgtcactgtcgagaagaaggaaggcaagctgcgcggacagaaggatgtcatcatcacggatctgcccggcatttacagcttgtcgccctatacgcttgaggaggtcgtcacacgcaactacatcatggacgagcggccggatgtcgtcatcaacctggttgacgcgtccaacatcgagcgcaacctgtatctgacgacgcagctcacggagatgggcatcccggtgctgatcgcgttgaacatgatggatatcgtcaagaaaaacggcgaccgcatcgatacaaaaaagctttccgagcagcttggctgcgagattatcgagacgtcggccgtcaagggcgaaggtttaaaagcgctggcggactgcgcggtcaagatggcgcggtccggtgtgaaaaccacgccgcagcacacgttcgaccagcgcgttgagcaggctctttccgaaatcgcatctctgatcagcgatgtggttccggccgaaagtctgcgctggtacagcgtcaagctgtttgagcgggacgaaaaggcgatggaacgcttttcattcgctgccgatacaaaggagcacctcgagcagatcatagccggctgtgaaaaacagttcgacgacgacagcgaaagcattattacaaacgaacgctaccagtatatcggcacactgatgcagagctgtgtacataaaaagaaatccggtatgacaacgtcggataagatcgatcagattgtgacaaaccgcatcctggcgctgccgatttttgcggtggtcatgtatattgtttatttcgtatcggtttcctggcttgggaccattgttacagactggacgaacgacacgttgttcgctgaaacgattcagcctgctgtcgcgggcgtgctcgagagcatcggcgcggccgcctggctggaaggtttaatcgtcgacggcatcatcggcggcgtgggcgcggtgctcggtttcgttccgcagatgtttatcctgttcttcttcctgtccatcctggaggactgcggctacatggcgcgcgtcgcgtttatcatggaccgtattttccgtcgtttcggactctccggcaagagcttcatcccgatgctgatctcctcgggctgcggcgtgccgggcgtcatggcgacgcgtaccatcgaaaatgaaaaggaccgccgcatgacgatcatgacgacgaccttcatcccctgcggcgcaaagttgccgatcatcgccctgatcgccggcgcaatgttccccaatgtcacctggatggctccggccacctatttcttcggcatctttatggtcatcatctccggcatcatcctcaagaaaacgaagatgttcgccggcgacccggctccgtttgtcatggagctgccgcagtaccacttcccggcgccaaagggcgtgctgatccacatgtgggagcgcggcaaggcgtttatcatcaaagccggtacggtcatctttgtggcctgcggcgtaatctggttcctccagagcttcggttttggtcctgatggattcggtatggtcgatgacgagaacatgagtatgctggccgctatcggcaatgtgctcgctccgatcttcgccccgctcggctttggaaactggcaggcggctgtcgcgagcgtctccggccttgtagcgaaggagaacgtcgtcggtacgttcggcgttctgtttggactgggcgaggtaggcgaggacgatccggccctgctggccgctctgcccacactgttcgccactcatgcaagcgcgcttgcgttcatggtctttaacctgacctgcgctccgtgcttcgcggccatcggcgcgattcgccgcgagatgaacagcgccaaatggacatggttcgccatcggctatatgacgggtatggcttatgtgatggccttcatcatcaatcagctcggcggcacgattttctatggcgttccctttggaatcggccaggtgattgcgctcgtgcttgtagccgctttgctgtggcttttgttccgcagctataaacccgccggaatgtccaagcgtccggccgctgccggcgcccgtgcgtaagcagaccggcaaaggaggcgcctttctatggtaaactggattattggcggcgcgattatattggcaatgttttttgccgctcgctatgcatggcggaaggctaaaaacggccagtgcgtcggctgctccgactgtaaaagcggcggctgccactgcggctgcggcggggacagcgcggatcacgccaaaaaaacctgacagttcaaaacacccgcggacagccaggctgtccgcgggtgttttttcctgccggttccttttcacccggcaacggccttgtcatatgccagcctgccttccccctgaaaaacaatcgttccacattttagaaacccgtttttctccagaatgtgctgcatacgtccgttggaaaagtctgtatcgacccggatgctcttgacgccccgcgaacggcacaggtcttcaatcagaagaaatacgcattttgtcaaccccgtgcctctgaacgacgcatcaaatgccattctgtggacaacggcatatggttttattgtatgccagccgccccggatatgatcatacgcaggctccccttcaaaatcgatacacatatacgccgcaattttatccccgaacttcacaacgtatccattttttctttcgatatcatctctgatagtatcgacatttggataatcgtctgtccattggacgaacccctgttccctctgaaagcgtttgcctgcttctatgatttcataacatcgattcaattcgtccatccgagccagttccaacggctgcattgctgcgtctctccttaaaaatttatttttccttctgagtatatcagaaaagaaaggtaaatgaaatatgagtgagcattccaactgtgtcatacaaaaagcgggcgtttagagcgcgcttgtaaattgccgcgcggtatagtaaaataaccgtgatacggttattttactattatatggccatgccgctttgcggatatggagccatgtaagctataaaccggcagccgtgctgtatgcacggccggaaagggattgcatatgatacatttcaaggctgtgcagccggtcgccgtgctcgcggccctgttgatattggcgggctgcgcgccgcgcagcgcggacaagccgcagcagacgccgccggatacggcagcgccgccgccgctttcggccgccagcagttctgcgccgaaggcagggccggcggctacggggctggctcttaaaacgcccggcacggcgacgctttaccgctttgtggcggcaggaccggatgcggatgattatgtttatacgccgctggaacgtgaggcggcggatgcgatgacagccgtgctgcttgatacgatcgtaagcggggatgatatgcagcccgcctttacagtattgtcgttgaaactggagggcgcgcgcgccgtggcggaggtccggtcgaacctggacgcgcagacggctcaaacagggcggcggcgctggcttgacacagcggcgcagacgcttttggagagctgcgccggggttgatgaggtgtcgtttgtggagaatggcgcgccggtagctgaacagggctttgcagacagctacaccccgccgccgctcgtgctgcctgcgctgacgcgcggggaaattgcctcgctgcgcgctgggatctcctacgacgagctgctcgaatggacgcgcgtgtatgagacgcaggcgttcggcgaacaggcgacgccgcgcggccgctgggatattgcgggcgatgaggagcgcggccgcgcgctcgactttatagcggacgttacgaacgctaatatcccggcggagccgtttgattcggttgcagaagcgccgggccgttttcttgtcagggcggcagtactcaacacgccgtcggtcaattggggcgtgtacggcggcgaaacatatgaaggaatccccacctatccttcgctggagccgctgaccggcctgatcggcgacagcacatgctttttgcaggagcatgttgaaattaccgccaaaaggctgttcggagacagcgtgcccctggttcacagcggcgcgggactaagcccctggcgctaccatgaatacgccggcgtctatacgccgccgcatatggggacgccataccctgattgcgtgctgcttgattacagcgcgtcgggagaaacggtcgaggcgaccgtcgggtatctcaatggatttgccttttccgaatcgcgctatggcgaggatgaacagacatatgcgaggacgcgtctgcgccgttaccgttaccatctggaacgcgccggagaatcgtttattatgacggcgtgcgaatttcttgacgacgacttgtcagcggcggcgcgcgatccggaacggattgcacgtgcggctgtcgacgctgggctgacgcttgcggattgggacagtcctgaaagtctgacgggcgaccagctttatgcgcttttttatgcggaggcgaacggtctgtatacgacgctcggtgagacgcatgtcccatgggaacggattgccggacgttttccggggcggcaggcggctctgcgagacagccgttattacaatgaaaccgctgtgaacagcgacggttcaggcgggggcgcgttcaccggcacgccggacgcctatgccgcgcgctggtgcgattatggagagatgacctttgccggcgatgaggccagcctgcccatgacggtgtatgccgatgcgcagcgtacacagactgtttccaaaggcgtgatgacctttgcggcggatgagtcgggatggacgcccgttggctggcgtatggatggagaggagtaaagatatggcgacactttttgtagtggggcttggtccaggcggcgcgtccgaccggacggagcgcgccgagcaggcgctcaaacaggcggaattgatctgtggttatacagtatatgtggatttagtccgggagcagtaccctgataagcaggtgcttacgacgccgatgacgcgcgagatagaacgctgccgcgccgctttggaagcggcggccggtgggcgtgacgttgctatggtgtgcagcggcgacagcggcgtgtacggcatggcaagcccgctgtgccagcttttgccggaatatcccggcgtacagcttgagattattccgggcgtgacggcggcgcttggcggcggggcggtgctcggcgcgccgctggcgctcgatttcgcggtgatctccctaagcgaccagctgaccccgtggccagtgatcgaaaagcgcctgcgtgcggctgcggccggtgattttgcaatctgcctttacaaccctgaaagccgcaaacggcccggctatctgcggcgcgcatgtgacatcctgctggaatgccgtgaggagaaaacggtctgcggattggtgcgcaacatagggcgcgcgcagcagggcgcgcagattatgacgctttcacagctgcgcgacacaccggccgatatgttcaccacggtatttatcggcaacagtacaacccgtgtcattgatggacgcatggtgacgccgcgcgggtatgagcagaggttcggcccggatttgcgctgattggccggatagattgacgataaaggggtaagatgtgatggaaacagcatggctgaagaactctaaaacaacccgctataaaagcggttcccgcgctgcggccggcgatccaaaacggaaagcgatcctcgccgtatcattcggtacaagctatcgaaaaacacgcgacgctgcgatcggcgccatcgaatccgatttgcaggcggcctatcccgattatatggtgcgccgcgcgtttacaagccggatgatcctgaaaaagctgcgggagcgcgacggcctgaaaatcgacacggttgccgaggcgctggaacgccttgccgccgaaaacgtgggcacgcttgttatccaaccgacgcatgtgatgaacggcattgaatacgaccggatgatggccgctgccgcgccgtatcttgaccggttcacggcggtatcgttcggtgcgccgcttttaaacagcgcggccgattatgacgctgtggcaaaggcgctgatcgcggagcttgccccggcggacgatacggcgcttgtgcttatgggacatgggacggagcattttgcggattccgcctatgccgcgctcgattaccgcttcaaagcgatggggtatccgaatgtgtttgtcggtacggtcgaagggtatccgctgcttgagcatgtgctggccggaatccgggcgggcggctatcgaaaggcgttgctttccccgctgatggttgtcgctggagaccatgcggtaaacgatatggccggcgacggccccgattcttggaaaaatcagcttttgcgcgcgggctgccaggtgcaatgcgtgctgcgcggcatgggcgaatacaaaagtatacgcgcgctgtatacggcgcacgcgggcgctgcaatcgcggcgcttgccggcgcggcggagtctgcgtgaaattcatatcgtgatcatatcctgagaaagcgccctgccgtctggtcagacggcagggcgcttataagagcctgttcagcatctccacgcacacgtcttgacggcgtattttccgccctgactgcgttaaaaatccttgctatccgccaggatgactgcggtgttttgccttgcagagcaaaaaattttcacgccaatgcatgcgctttcctcaataggaacggcttctaaaacttccagaaaatgcggactgcctgtgtgtcctgcaggggatcgcgttcatcaatttcaatccggtcgatcagcagcgccgcgagcgagcggaaaaaccgcccgggcgagagcagttcccggatatgctgtgccgtacaggccggcggggcgtcgtgcgcttgagcggcttgcgcctcaagcgccgccaggtgagcgcgcagcgtgtcggcttctgcctgaaacgacgcgcccaacgcggcgaactgctccggcgtaaccgttccgtcggcgcggtccagatagagcgtgcgcaaagccgcctcacggcgcgcaagctgcgtgcgcagcgcggcaagctgcccgctggccgctgcggcgcgcggtttttggggaagatcgcggatggaagaaccgggggtataccaccgcgcgatttgttcgcgcagcgctctctctgccgcgtctgtcagcagatccaaacggatggagtgccgcgtgcacggcgcgcccgcccgatcggacgcatatcgtccgcattgcagataggaccgctttttccctttataggtgtgtgaaacacggatcattgacgcgccgcaagcgccgcagcggacgagtccggcgagcggatgcgtttggccgctcccgtcgctgcgcgtgcgccgcgcaagcacggactggaccgtttggaaaacctgcggatcaatgatcgcctcatgcgtgcctggaacacgtatccacgcttcgcgcggcacgctgacgcagagattcgatttgtagctgattttatgcttgacaccctgcaccattgtgccggtataaagttcattatgtaaaatccgtccaactgtcgcgcggctccaaagcgcgcttttgccgccaggacagatccagccgcgcgcacgcttgtaggctgttggattcagtatgccgcgccggttgagctcggcggcgattttctgtttgcccattccggaaaggcagagcgaaaaaatgagccgtactgtttcggcggcctgcgcgtcgatcacaagatgattgtgatctgccgggtccttttcatagccatacgccgggaaactgccgatatactgcccggcgcggcgtttttgtgcaaagactgcccggatgttttcagacaggtcctccagataccattcgttgacaagcccgttgatctggcgggcctttttgctgccgcgcagcgccgtatccacatggtcgacgaccgcaatgaaacgaattccccacacaggaaaaagcccgtggatatatttttccacaagctccagatcgcgtgtaaagcgcgactgcgttttacataaaataatttcaaatttttgatcgcgcgcgtcacgcagcatccggttaaatgccggccgcgcgcggtcggcgccggaatagtcgtcgtcgcaataggccgcgtagacttcccatccgcgttccgccgcgtattcggtcaaaagggcgcgctggttttgtatgctctcgctttcccgcgtgccgtcgccgtcctcccggctcagacggcagtaaacggcgcacttcattgtatatccccatctgccgccagcccttcgctgagcatggcgcgcagatattcgtcgagcagcgcgccgatctgttcacaccgcgcctgttccccgtccgattgatagatgtctgtaattagcaaggccgtcttgtccgccatagtcgtccctgccgcattgtatgcgcaaagggaatcggatatgccccgggcgcgcgtgacctgttcgcgcgcgggccgtgcacaaaggccccaaaaaaggaggaagcccacagccgctgtttgcggacggctgtgggccaggcggagaaacccgatttgcaccggctgccagttcgcacccggcgcgaactgtgcggcgcggccggcattcgtggtcggctccgcggggtagggattggcgatcccgtttgcaagaaaaacgctgcccgtccatttcaccgccggcgaaacggcaaatggacacagacaagaaagaggagacgcccatgctgtgtgtgtgcacaacaccaggctttagtctgaccaaagggcacaatcaggagcaccgttttggccaaacattgagaggcaactcgttcccatgagcacatctcttagttagcattgactaactatctatactttaccaccccaaaacaggtttgtcaatagcatttttaaaattttttcgacgcgttgcggttgcatctttttttctgcatgctatactgaatttcagacgattcagatgggggattttgtcgtggaaaaaataaagtatacagcaagtgttcccgcttccaaggaggcgctgtgagccggcgccggcgccgcggacgcggcgggcaggttccgatacttccgtttctgtgcgcaggcggtataatttttgcggcttttttggtcgtcgtgctgctcaacgatgcgatgggcggtcagcttccgctgccgacggcggcgcagatcgaatcggccgctgcgggcgctttggacaagctgtacggcgccgcggatcttgtcccgcagccggtgcatgtggatggggaggtgtctgtccactttatagatgtgggacaagctgactgcgagctgatccaaacgccggaaagcaccgtcctgatcgatgcgggcgatattggcggcggggacgctgttgtggcatatctcaaggcgcagggcgtgaatcgaatcgatctgttaatcgcttcacatccgcatgccgatcatattggcgggatgaaggaagttgttgagacgttcgatataggaaagatcatcttttcggatgtacctgacgaactgattccaacgagcaaaacctatgaaggcctgattgacaccatcgccgcgcgcgggtataaaattacgaaagccaagccccgcgccgtctatgatctgggcggcggcgcgtcgctgacaattttggggccggtcgcccagtatgacgatttgaacgaaacctctgtcgcgtgccggtttgattttggaaagacttcgtttttatttacaggagacgctgaaaaggaaaatgaaaacgatcttgtggcggcgtatggctcggcgctcaaggcggacgtgttcaagctcggccaccatggaagcagcacatcgaatcagcagaagcttttgaacgcggtcgatcctgatattgccgtctgcgaggtgggatatgacaattcctatgggcacccgcatgctgagacgctcgaacggctcctaaagatgggggtcacgctctatcggaccgaccgcgacgggacagttgtcatcggctccgacggagagacgctgtctgttgcaacggaaaagtaacgggtgcggcgtttgttgcgactttatggacaaatgttgcatactttctgtgaagcattgacacgcccgatgcatcgaattatactaaaatcaagcaaaagacaactatatcgttgctttaaaggagtgattgcacatggcaattttggtcacaggcggcgccggctatatcggttcccacacctgtgtggagctgctgaatgccggtaaggagattgtcgtcctcgataatttcgtcaattccaagccggaggcgcttaaacgcatcagcgacatcactggcaaatcgtttaaatcatatgaggttgatctgctcgaccgcgacggtgtgcgccgtgtgtttgaacagaatcagatcgacgcagtcatccatttcgccggtctgaaggctgttggtgaatcgtgcaaaattccgctgcgctattaccacaacaatatcaccggcacgctgatcctctgtgaggtaatggctggtgcgggctgcaaaaagatcgttttctcctcgtcggcgaccgtttatgggatgcacaatcaggtgccgtttcgcgaggacatgccgctgtcaacgacaaatccctatggtacgaccaagctgttcattgaacagattctcaccgatattcagaaggctgatccacagtggagcgtcgccctgctccgttacttcaatccgatcggcgcgcacaaaagcggcttgatcggcgaagacccgaacggcatcccaaacaacctgctgccgtatatcgcgcaggtcgcaaccggaaagctgcccgacctggcggtttatggagacgactatgatacgcccgacggcaccggcgtgcgcgactatatccatgtggtcgatctggcggttggccatctcaaggcgctcgattatattatgaaccgtaccggcgttgaggcgatcaatctcggaacgggcaagggatattcagtgctcgacgttgtccatgcatttgaaagagcgtgcggcaagccggtcaagtaccatattgcgccgcgtcgtgacggtgatatcgccacatcttacgccgatgcctccaaggcgaaggagctgctcggctggagcgcggagcacacgctcgacgagatgtgcgccgatagctggaatttcagtaaaaggaatccaaacggcctttaaggacacaaagcccgcgcgctggctaaagccggcgcgcgggcttctttgcctccgtgggcaggcttgcattttatagggaaaactgataaactaaaggtattcttgtagaaattgttacaaaacaaatgaaaaatcaggtgaggttttttatgcctaacacgcacaaaaaaaatattcatgccaaatcggttttcagcctgctgctgagcaagatggcaattggcgtcttgctgattttggtacagattgccatcctggtattgctggtattgtttttgagcgattacttcaccattgtctatggtgttttgtcgcttttaagcgtcggcattgcagtctggcttgtcagcaaaaatgaaaatccctcatataaacttgcctggatcatcccgatcatgctgtttccgttgttcgggggagtcttttatctgatgttcggcaaccagagcatgccgaaaaagctggtggaccgcattcgggaggcggaaaagagcgagcaccgtgtcgcgccgccggacgagccatgcgccggcgagctgatcacaaacgatccgcagcttgggctgatttccaattatatcacgcggacaaccggatcgccagtgtggaaaaacacgcaggcgcagtatctgccgatcggtgaaaccatgtgggcgcgcctgcgcgaggagctgccaaaggccaaacgctttatcttcatggaatattttatccttgaggaaggcgaaatgtgggaaccgatctttgagattctcaagcagaaggcggccgagggggttgaggtccgattcatgtacgacgacctcggctctattatgacgctgcctgtcaattacgacgttcaattgcgcaacgcgggcattcaatgcgcggtgttcaaccccttcaagccgcatctgaatgcgaccatgaattatcgcgatcaccgcaagatcactgtgattgacggcaatgtcggcttctgcggcgggatcaacatcgcggacgaatatatcaacgcgtacgaaaagcacggccattggaaggatacgggcgtgctgctgcgcggagacgccgtttggaacctgacggctatgtttttgtccctgtggaattttaccagcccgacggacaaacagtttgagcagtaccgtccgacaatccactgtgaaagcgacggctatgtacagccattcggcgattcgcctctcgatcatatcaatgtctccgaggagacatatatgcagattatcaaccgcgccacgcgttatgtttatattacgacgccgtacctcatccttgacaatgaaatgatcacggcgcttcaagtggcggcgcgcagcggcgttgatgtacgtatcgtcaccccgcacgttcccgacaagtggctggttcaccaaacgacgcagtccttttatcaggtattgctcgacgcgggcgtgcgcatctatgagtatacgcccggctttgtacatgccaaaatgtacgtatccgacgatacggtcgcgatcgtcggcacggccaatatggattaccgcagcttttatctccattttgaatgcggcgtttgttttttccggtcgagcgtggtgcaggatgtgcgtgccgatattgagcatttgctgacgcaatgctttgaaattccaaaggattatatccggcatgtgcgcctgtggaagcgtattgtccgcgcgtttttgcgcctgttctccccaatgatgtaggcgatgccggcccggccgtcttttgcgctccgctttcagggcggggcgcttttcatttaaaatattttgagtcgccatgggcctttctttcgttggatttttctggtacaatgtattaggtatacgagggctgaccagccggacagggggactgagcatggaacaaatgtatgatcttgcggtcattggggcgggaccaggcggttatacagccgcactgacagcggcaaagcttggtatgcgcgtcatcgtttttgaaaagcgggcgcttggaggcgcttgtttaaacatcggctgcatcccgacaaaggcgcttgcctgttcggcgtcgctgtatcagacatttcaaaattgcgcgtggtttggcctgtccgcgccgcagacaggcttcgattacgcaaaaatacacgcctataaggagctctgcgtttcacagtcgcgcgagaatatccgcgctcagtttgaggcggaaggcgtcgtttatattgagggcagggccgccgtcgcgggcgcgcgttcagtgcgcctcaccacggcggacggcgtacagcggatgtacaatgcgcgctatatcctgattgcatcgggcgcgcgcccaaacaggccgctgtttccgggcgtgctgctgccgggcgttgtgacaagcaccgacgttctgacagacaaccagtggcattacgaccaggtggcagtcatcggcggcggcgtggtcggcgtcgagcttgcaaccatcctgggcgctctcggcgcgcatgtgacgattattgaaaagaaagaacgtctgcttgcgcccatggacggggagctgtccgccgcgcttgaaacgctgctgcgccgccgcggcatcgaggtgttgacaaacgcaaccgtcgagcgtgccgcagaaggggacggcgctctgacctgcacagtccggcaggggcaggagctgtcagcacgcacggttcagcgcgtgctggttgcagtcggacgcaaaccgtgtctcgaggggctgatcgatgataaagtgcccatccgcgcggacgaccggggcatcattgtagatgaaaacttcatgacaagcgtgcgcgggatctatgccgtcggcgatgtgctgggcggcgttcaattagcgcatctggcggccgcgcaggggatgcgcgtggtggagaagctgtgcggcaaaacgccgtcagtgatgctttcaaccgtgccgagctgtgcgtttgttgatcttccgatcgtgccgagctgtatttatatcgatccggagatcgcgtctgtcggcatcaccgagacggaggcgcgcaaaaacgggattgctgtgcgctgtggaaaatcggagatgagcggcaacggccgcgcgattatttcacatgaggaaagcgggttcatcaagctggtgtttgaagcgcacagccacatgctgatcggcgcgcagatgatgtgcccgcgcgccacagacatgatcggcgagatggcgaccgcgattgcaaatggattgaccgcgcgccagctccggtatgccatgcgtgcgcatcccacctttaacgagggtgtcgccaaagcaattctgcctatataaaaatatgtaaagggatcggatgtgcagcctgcgaaaatgcagtgcccgccccgctgttcgcggcgcagccgactaaagttttttggcatacctttttttcaaaaaaggtatgaagttttcgccgaagccttttttcaaaaaggctggagagagtcgaggcgggcgcgcaggttgataaaatcgtcgagcgcgccgggcttgttgacagggttgcgcagcagggcggcgggatgaaaggtacccatcatcataaggccgtccttatcaaagaattcgccgtgctggcgtgtgaccttgaaattcggatcgatcagcgcgcaggcggcgacgcgcccgaggcagacgatgatttttggccggatgaactcaatctgcgcgcgcagatatggcatacaggcttcgacctcgtcgcgttccgggtccctgtttttgggcgggcggcattttaccatattggtgatgtaaacgtcgttctgacgcgacagcccgacatgcgtcaaaatcttatcgagaagctgtcccgcgcgcccaacgaatggttcgccctgcaaatcctcgttttcacccggaccctccccgataaacataattttggcatgttggctgccagcgccaaaaacaacgctgtggcgcgtctggcacagcttgcagccctgacatgcaagcgcggcactttgcagcgcctgaaagctttcatacatggcggaacctccattttatccctaaattgtctttggccggacaacacccttttctttcccttgaaatggagcgcggtcatggctttgcttacagtttaattgtatcgggaacaaatgtcaaatcgttgattttttcgcaaaacgcttgaaaaaaatgcggacaaagcgtacaatggaactgtaccataatttcgcaattggaggattaaggatatggcaaatacgtttattgttgagacttctgcgcgtcatctgcatgtgacggagcaggacttggaaacgctgtttggcaagggtgcgaagctgcactataaaaaggagttgtcgcagcccggtcagtatgcctgcgaggaacgcgtcgatgtcgtcggcccgaaaaagacgatcaatatgtccattatcggaccgtgccgccccgcaacgcaggttgaggtcgctttgaccgatgcgcgcgcgctcggcctgacgccgccgatccgcgaatccggccatgttgagggcagcgccccgtgcaagctggtcggcccgtgcggtgaggtcgaattaaagcagggcgtgattgtcgccaagcgtcactgccactttgatccggcgtttgccgagcaggtgggggtcaaggacaaggacattgtgtccgttaaaatcaatacgcccgagcgttcgctcgtgttcggcgatgtggtgatccgtgtcagcccggcattccgtccggcgatgcatatcgataccgacgaagccaacgcggcaggctgcgcgggcgaggtgctcggcgaggttgtcaaataagcggcctagtgcatataacagcgggacggcatgggtacatgccgtcccgctgagtattttcatttgccgggtatcgctattgtatcgggcgtcaaccgtgcggcagccgatcttttatcgccctgtcatggattccacacattaataacacaattttcctccatactgaaccacagcaagctgtgaaagggtgcacatcatggacaataaaattcttgtggcggaggatgaggaaaaaatccgccgtcttgtttcaagctaccttgtgcgcgagggttttaaggtggtggaggccgcagacggacagcaggctgtcgaaagatttgaggacaacgaggacgtcgtactggtgatgctcgatgtcatgatgccgaaaaaggacggttatgacgcctgccgagaaatacgcggcaaatcgaacgtgccgatcctgatgctgacggcgcgcgacagcgagcaggacgaggtggcagggttcggcgccggcgccgacgagtatatcgccaagccgttttctccgaccattctggtgacgcgcgtaaaaaaccttttgcgccgcaccagctccaacgatatgagcgacgtatcggccggcggcgtaaaggtgctttaccgggagcgcacagtgacagtcgacggcaaaaaaatcattacaacgcccaaggagttcgacctgctttattatttgatccgcaacacaaacattgttttgacacgcgaccagatcatctgcacggtctgggatatggattacgccggcgacgaccgaacggtcgatacacatatcaaatgcctgcgcgccaagctcggtccgtatgccaaatgcatcgtcaccgtgcgaaaggttggatataagtttgagtggctggaatgactggggcctcaagcgaaaactgtttgcaattatcctttttatactgattgtaaatattgttgtgctgctgtttatgggttccactctgtttgaacgcttttatatcggcaacaagcagacagagcttcagcgcagcgccgaaaaaatccgggaaacctatgaacagagcagcgccgatttctatgatgaaattgaactgattgagaacgaaaacgccactgtgacgctgttcgagatcgattccaacggttcgcttgcagtcaaataccactcgcgcgccggcaaggatgagatgcgtccctggggcgacaagccggatatgcctgttccgcgcgatgatggcatggagcggtttaaaaaggatatgctggaccggctcctgcgcgcggacgacagctacaatatccgtgtggaggcgccgtttggccgtgacgatgtcgatggttcaattactttgacaacgcggctcgacgataacctctatttatttatggaatcgccgcgaggttacatcaagtcgagcgccgatctggctgtgaagtacacggcctttttgtccatcattattctgctgatcggttcatggctgatctatctggccgttgaccgtatgacaaagcccatccgaaacatacaggaggtcgctgataaaatttcccgcctcgatttctcccaaaactgtccggcgcgcggcagcgatgagatcgcgcggcttgcaacctcaatcaacaacatgtcggatgaattgcagtcgaacatcagccgtttggtggaggccaacgacatcctcaaaagcgacctggagcgccagcagcagacggaactgatgcgccggcagtttattgcgaatgtttcgcacgattttaagacgcccctgaccctgatgatcagctacgcggaggcgctttctgaacaggcgcatggcgaacaggcgcaggaatgctgtgagatcattatcggcgaggggaacaagctgtctgcaatggtgggacggctgctcgaactgtcgcgccttgaaagcggcgtggcccgcgctgaaaaatcgatcttctgtttaagcgaggtgcttgacgaatccgtgcgcagcctgcgtattttgacagagccgcgcgggatacaggtgcgccgttgtctggatgaggagttcatcgtctgcgccgattataccaagattgaccaggttgtgacaaacctgtttgagaacgccgccaaatatgcgccgaagggagcggttgtcacgctgcgcgcgcagcgtgccggtgtggatgcgtgccgcgtatccgttgaaaacacaggtgcgcagattccgcaggaggatatcagcagcctgtttgacagcttttaccggggggataaggcgcggtccaacgatggacagagctatggcctggggcttgcaattgtgcgcggcattatggatgcacacggccgcccctacggcgtggaaaatattgaaggcggcgtgcggttttggtttgaactggagttggcggacattgacgataccgatggcagcggcgaggatttgccggaggaagaactgtaagcatcagaagacagcctggaggaccgccgggctgtctttttttctggaaatttggatcgtcctgcgctataataaaaccatgtaaaagacaaaagcggcacagtgtcaaagtatcaaagcgcagatgcgcgcagttgagaggtgtattatgcaggagcgtcacggagcgcagtttggcagcaagatcggttttattctggcctcggtcggttcggcgatcggtatgggaaacatctggatgtttccataccgcgtggggcagtatggcggggcggcgtttttaattccatatttcctgtttgtggcgttgttcggcgcggtagggctttcgggtgaatttgcgcttggacgtctgacggggacggggcctgtcggttcctatgattatgcaatgcgcacgcgcggtttgcgcggcgggaaattgctcggtgcgattccgctgctcggttcgttcgggattgcaattggctattccgtcatcgttggctgggtgctgcgttcggccgccggcgccgcggcgggcgggctgtttgccgccgattcggaaacgtttttttctcaaatgacgggccgctttggaagcgtgccctggcacttggcggttgtggcgctgacggtgctgtttttagcgggcggcgtcatcaaggggattgaaaaagccaaccgtttaatgatgccggcgttttttgtgttgtttatcgtcattgcggtgcgtgtcgcattcctgccgggcgcgggggcgggataccgttatctgtttgttcccaaatggagcgccctgcttgacatgcgcacctggattatggcgatgggacaggcgtttttctccctgtcgatcaccggctccggaatgattatctatggcagttatctggctaaaacagaggatatcccccatgcgtccgcgatgacggccatcctcgacacgctggccgcgctggtcgcgggctttgcggtgatcccggctgtttatgcgtttggccttgacccgcgctccggcccgccgctgattttcctgacgcttcccaaggttttcgcgcagatgcctgccgggcgtctattcgcggttttgttttttgtgtcggtattttttgcgggcgtcacctcgctgatcaatatgctggaggtgtgcggcgaggcgctccgccgccatctgcgccttggacgcctgcccgctctgcttataacgggcgcgattgtgttcggcgcgggcctgtttattgaatatgagccgtatctcggccgatggatggatgtggtcacgatctatatcgtgcccatcggcgcgctgctcggcgcagtcatgatctattgggtgcttggtatggacaacatcggcagggagctgatgacaggccgtaaaaagccgcttctgcatggctttgcatttctggcaaaatacgtctatatttttctggcgggcgctgtggtcgtatgcagctttacaatcaagggaggcatcggctgatgcggcttgcggcgattgcctgccgtgttttcacgcgtgaattgagcgcggccgtcgccaaatgcgcgcatccggtggaggtcagttggctgcctcagggtttgcacgacacgcctgatttgctgcgcgcgcggattaacgcgacaatcgatgcaatcgaacgcgccgacgccgaagcgcccgcccgccgccggttggatgcaattgtgctttgttacggcctttgcggcggcggacttgacggtgtgcgcgcgggccggctgccgctggttgtgccgcgcgccgacgattgtatcgggatattgcttggctctcaaaagcggtatcttgattatctcgccgcacgcgccggcatttactggtatacgccgggatggattgaatatgcggacacgccctcgcgcgtctattatgatgcaaagctgcgcgactataccgcgcggttcggcgcggagaacgcgcaatggctgctggagcaggaaaatacctggatcggcgcctatgagagcggtatttatattgcgccgcccgcctgcccttccggcgcgtttgaagcgttcgcacaggatgctgcgcgcatgtatggctggcgtttcgagacggttttgggcagcgccggctggctggaggctctgctttccggcggctgggatgcgcgccgttttgccgtctgcccgcccggcgaaaccctatcccgcacctacgacccgcaaattttcccgcttttttgaaaaaagcctggcaaaaaactttccggcttttttggaaaaaagcctggcaaaaaactttccggcttttttggaaaaaagcctcggcaaaaaactttagtcggctgcgccgcgaacagcgggacaggtttcggcatttatgcaggctgcgccgcgaacagtggggcatgagcgtttctaatcggtacagtttcttatattgcggtgcgccggcatggggcggcgtaccatccgcaatcgaggttttgatatcaggcaggattacgccatcgagcgaatcggcgtccgatgaacagtggatcaattcgacctgcccgcagcggtccgccgcaaaatcagccacccgcttcatcagcgtcgattttccggcgcccggaccgcccttgatgacaaattcacgccatccatccgttggatcagcgagctggtcaaagcgggaaacgaagccctgcggcgtgtttgctccaagaaaaaagcgcaggggctttgcggtatcactcatataaagacccattcctttcgcatcttgatgaaagccgcggacggccggcgcgaagctgccgcgcctttttttaccgcgcgtttttctgcgtgcaccgcccaaaacagccgttatttcatcgtattcccatccgtgcaatttggttcgtcggaaaaatctgagaaaatagaaacgcaaaagtttgttaagccgcggggagcggacagcagaaatgctgtccgctctttttttctccataagcgtccgaaagtgcctctgtatgaatgcgcaattctcacaaattttagaaggaaagcttgtttatgtggatgaaattggatgtttaggcaatatttgattgactttcgtattagcaaactatataatatcgacatagcgaacaactgaataaatgaaacagcgaaaaagaagggagatggagatgtgaaaattataaaggtcgaggtatttcgacttccgaccgccaacagcaggcaaaacagtccgattggctgccgggtctatacggatgcgggaatttacggcgacggcgaagctggtatggcctatggcgtgggcggctccgcagcgtttggaatggtgtgcgatctggcggagcttgtcatcgggatggacccgcttgggacagagctgatctgggagacgatgtataaaaaaaccttctggggccagaacggcggcccggtcgtcttttccgggatcgctgcgatcgatgtggccctgtgggatatcaaggggaaatatttcaaggttccggtctatcagcttttgggcggcaaggtgcgcagccggctgcgcacctatgcaagccagctccagtttggctggggccgggtgggtgtcagcgaacacctgtgggcggtgactccagaggattatgcccacaatgtcaagctggcggtcgccgaaggctttgacgctgtcaagatagacttttttgaccgcgatgaacagggcaggccgcttaacttcctggatacgaccggatttttgacgcccaaacagctcaagatggtggaggcccgcatgaaggctgcgcgggacgcggccggggacgaagtggacatcattatggaaaatcactcctatccggatgcgctcggtgcggtgcagcttgcacagcttgcggaaaagtaccgcatcctggcttttgaggagccgaataccccgactgcgcagaccgtggagtatatcgcaaaatatacaaaggttcccattgccaatggagagcgtctcttttcccgctggcagtatgcaggttattttggaaaaaacctgctccagcttgcacagcctgatatcggcaactgcggcggcatcagcgaggtcaagaaaatttgcgatatggcacatgcctttgacgttggcattcagatccatgtggcgggcagtccgttggcaaccaacgctgcgctgcatgtggaatgcgccatccccaatttcgtcatccatgagcatcacacctgcaaccggatggatacatgcctgggcctgacaaaatacaatctccagccggaaaacggctggttctcagtcccggaggaacccggcatcggcaacgaattcctgcgcgaagccatagaaaaagctgtgatgtataaaatgatagaataatacggtttgtatagtgtgggctggaatcctatgctgcgaagcggcatggaatcacaggccgcaaagcggcgggccgcgtccgcgcaccgcccggccataagcggtatcataaccgctctgcggttatcaataaaacaggcagcgacatgattaaggagggacatctatgaaaatcacgaaggtagacgtcattcaggaaaaggttccggagcgggcctcgtggcggcccatcctgtgccggatttatacggacgaaggcatctacggcgacggcgaggccgctctggcctatggaatcgcggcgcctgctgcgttcggcatggtcagggacctggccagtctcatcatcggcatggacccgctcgacaacgaagtgatctgggataagctttacaaatgcaccttctgggggcagaatggcggcccggtggtttttgccggtatctccgcgctcgatatcgccctgtgggacatcaaaggcaaatacttcggcgtccccgtttataagctgctgggcggaaaacgccgcgacaatctgcgcacgtatgcaagccagcttacatacggctggggtcccggcaccaaccataagtgctgcaagcccgaggaatatgctgagaactgcaaaatcgcagtggcgcagggttatgactgcgtaaagctcgacttctttaactatgatgtggacggaacggtttggaacgggccgggcgacgcgtccaaaggcgaaccgatggccggtgaaattcagacgcgtttgctctcgccttactatattaaggtggttgaggatcgtgtcgccgcttgccgcgaagccgtgggaccgtatgtggacatcattatggaaaaccattccttccctgacgcgcagtccgccgtacagctcggccgggcgcttgagaaatacaacatcttctattttgaggagccgaacaccccgacgcccaagacggccaagtttatttccgataagctgtccatgccgatttcacacggtgaacgcgtctattcccgctggcagtacgcgccctattttgaaaacatgtccgtccaggtgattcagcctgatcttggcaactgcggcggcatcaccgaaggcaagaaaatctgcgatatggcctatacatacgatatttccgtccaggcgcatgtctgtgcatcgccgctgtcgaccgccgccgcgcttcacctggaatgcgtgatccccaattttgtaattcatgaacatcatcagatcaacctggaggaatataacaaacgtctgtgcaccgtagatttccagccagtcaacggcaaattcaaggtgcccgagggtccgggactgggcgctgaaatcagcgaatgggccttgaccgaaggcgtggatatgaaagtcacggtcgaataacgccgtttcatacggattagccacgcggcgcgcgccgccgtaaaaaatccaagtccgccgcgccggaaaaccgacgccgaagaaaagggcgcccttttcttgtcttgcgcaattgcgcaagacaattccctctgtaccgccggacagaaggcgcggcgggccgtatccccatacggcggggaatcgaacggcagagagaaattcaaacatattggaggtttcgtttatggcaatcaaagttgttcatgaaccagagccgaagcccggcagtctgggaaagcctgaactttatgcgctggccatcggccaggtgatcggcgccggcgtcatcacccttattgtcccggcgatcaaaatgactggatactccgcctggctggcatactttgcggcgatcatcatgggctttgttatgatcctgcccacggtttttgtttcctccacggtccgcatgggcggcggcaattattcgatgctctgcggcctggctggtcccaatattgcaggcatctatgctttctcttatctgacgcagtgtttgtctctctcgttgttcggtgcttcggccgctgcctatctgggtgacatcattccggcgttgagcggccatttgccgcgcgtcattgtgggcgccgccctgctgacgtttttctttgtggtcaatctgatgggaatcgatatcatggcgtcggcgcaaaagctgatgacctggctgctgattgcggcgctgatcctttttgccgttgtcggcatcgccaggatgaagctgccgattttcgatttttccgatcccaatttcctgattaacggatggggcatcacctttgagaacgggcagatttccggcggatttatcggcgcgacgcttctgttcgtttattccacgcagggctattatatgacgacggcttacggcggggactccaaaaacgcgcgccgcgacatcccgattgttttgctgcttgccgtccccacactgatcgtcctttatgtgggcgtggccatggccggcgtgggcgtcatgaccgtggaggaatacggcgcttccacaacgctcgtgttcgccgcgcagcgcatcttcccgacagttctgttctatgcctttatcatcggcggtcctatcatggcgctgctttccacgctgaattccagctttgcgtataacgccatcaccatcggccagtcatgcgacgacggctggctgccgaaagcgttcggcaaaaagaacgcgaaagggtcccgtgtctggatactcacctttatgtatgtcgtgggcatgatcccaatcgtattcggcctgtcgatcacggtcatcaccaacatggtgcagctcatcggcgcgtgcttcgcctttcttaattttgtcgcgtatatcaaaatgccgaagctctatccgaatgcgtggaaaaagtcgcgattccatatccccgacggcctgtactatctgatctgctgcatatcgctcgcgggctttatcgtgacgctgtggaaatcctgcctgtccatgagtcccggcctagctgcggccaacgtggctgctatcgttgtgctggcgatcatcgggatcgttcgcggcaggaagggcgagatcgaagtacatacgtccatctggtccggcgacgcggccgaggatgcggccgccgcggccgtcggtcaaaaatgacaggcgctcatgcgctctgtcctgtataaatcatatggctttaaaacaatttgaaaacaagcaggaaaggaagacgattgtatgaaaatcacaagcgtggaatgctatctggcggacggcggattgggcggtttcgttaccgtaaaggtaaataccgacgagggcatcagcggctttggcgaggcgggtcttgcctatggaaagtgttccgaggcggcgttcggccagtgtcaggattttgccaaaatggtcatcggcatggacccgtttaacaccgaggaaatatgggagcatctgcaccgccacaccttctgggggatgggcggcggcgtggtggtgacttccgccatggcggccatcgacacagcttgctgggatatcaagggcaaggcgctcaatgttccggtttacaagcttatcggcggcaagacaaacaagaagctgcgcgcttatgccagccagctccagttcggctggcgcacgctgatcgagaaaaacgacgcgctgacgctgctgtatgatccgcaggattattacgatgtggtgaaggacgctgtggccgaaggttacgacgccgtgaagatcgaccccgtattcgctccgctggaggatgcgggcatggccccctttgccacacagggcaaccagatccgcggatgctaccgcgagcacgacctgaaacgttcggtcgagcgtatcgccgccgcgcgtgaggcaggcggaccggaccttgacatcattgtggaaatccattcgcttctggacgccaacaccgcggcgatcctgggcaaggcgttggagccttaccgcatcatgtactatgaggagccgactatgccctgcaatccggacgtattcaagcacatcaaaagccgctgctccctgcctttggccactggagagcgcagctatacgcgctggggattccgccagttctttgaggaccggacgctggatgtgatccagcccgatctggccaataccggcggcatcactgagacaaagaaaatctgcgatatggcgcaggtgtacgacgtcggcgttcaaatccatgtgtgcggcggcccgatcgctacggcggcggcccttcaggtcgaagcggccatcccgaactttgtcatccacgaggagcacaacgccaatctgctcaaggtctttaaggaggccggaaagtactatcacgcgccggtcaacggcttctatgatgtcccggagctgcccggcatcggccaggagatgagcgaaaaggccatggccaccgcccgcagggttgttattgagtaatcccttcccccacaatgatcgcctcctccgtccttcggcgggggaggcgattcattttcagccccggatacgggcgaagatgagaggagatgaggttttatggagctgctgaaattagcgggcgtattctgtgtgatgattttagtcctttggcggaaaaagccgctgtcctgggcggttgccgccgcggcccttgcggtctggctgctcttttggatgcccgcgcgcacattcgcggcggctttggtgcgcggcgcggtcagatgggataccattcaactgctgctggtgctttatctgattacattccttcaaaggatgcttgaaaagcgcggatgcctgacgagcgccaaggacgcgctggacgggctgttcaacagccggcgcgtcgacgcctccgcggcccccgcgctgctggggatgctgccggccgtgggtaccgtgctgatctgcggcgatatcgtccgccagagcacggacggctttttaaagacagaggaacaggcgtgtgtgacctcctattaccgccatgtttccgagctgttttttccaacctatacctccatcctcatcgccgtcgatctttcagcgggcaaggtgagcgttggcggatttacactggcgatgctgcccatgctggcggtgctgatggcgattggctggctgttttacctgcgcaggattccaaaggacgccggcttttttgccggacggcccaaggctttttattggaagctgctgttaaggtcgctttggacgatcatctttacggtgatcctgattgtggcgttcggcgtaccggtacacattgcggtgctggcctgtattgtctgcaacctgtttgtcggaagatttggctggaaggagcttcgtccctttttcgcctcggcttttgaagcgcgtctgatgatcagcacgctgctgattatgatgttcaaggaggtgctggccgccgcgggcgtgatcagcgcgctgcccgcctttttttcatcgctgccggttccgccgtttttggtctttgcgctgatttttttctttggcagcgtcgcggcgggcagccaagcgatcattgtgctgtgtatgggcatggctatggcggctgcggcgcagggcgggctggccctgtttgtgctgctgatgtgtatggcatacgcagccatgcagctttctccggttcatgtgtgtctggctgtctgcgcggaggattaccgcatctccctggggacgctgatccgcaaaaccgttccgctggtcggcgtattctgtctggcagcgtttggctactatgggcttctgcggctgttcggattttaactcaggcgtgaaaataaaaagcatatcgcaaaaagagggtgcaactgctgaaaaactggtgtataataaaaatacagacgaaagcgatcagcagggatccttttgactgttcagatactaattgattaggtgtggatatgctatggagaaaaagacgcctgccggccgcagaatgaagattgtcaagatatccattgtggatcaggtctgcgacgccgtcaaaaaggatattatgaacgggacatggaaggcgggggagaagattccgtctgagtccgagctggccgaacagttcggagtcaaccgtttgagcgtgcgcatggcccttcaaaagctgaacacgctggggttgatcgagacgcgcgtgggcgaggggtcgtttgtccgggatttttcgctgggcccctttttgtcggaaatttcctttatctattcctccgatgagaagtatcgggaggtccgccaactgcgggagcttctggagggcgacagcattaatatcgccattcaatcggcgacgcaggaagaaatagacgaactgaaacaggcgcttgatctctactttgaacaggcaaagcggtatcatcagaatatcgacagcgaggaggagcttgaacggctggtagacgccgattttaatttccattacaaactggttaaaatgagccgcaacagcctgtataaagatgtgtactatatggttcagcagctgatccgccagcatatcagcaaacttgtctatatccgcacgcatgaggcgggatgggcgccgcaggagcagcatgacacgcatctgaaggtatttaacagcatcgtcaacgccgatccggacgcggcccgtcaggccaaccgggagatgctcggcatcgtcccgattgccggtgtggaggaaaaggttcctcttgattggtagacggatgcactgcaaaagctcccgtgtcacggtaccgtgacacgggagcttttcttcattgtttgaatcagccgaatgggtgctcaatgcgcgcccgcaggctgtcgggcagacgttcgagcgggaccagcgctgaaccggcgctcgcatcgtcgaaccacagggtcacatatgcgacaggttcgccgtaaacccagcgcgggacggcggcctgcataaagacctggatatcatccggatcttcaaacagggaaagattcgagctgtccaggctttgcgcctgctcggcggcggagccgtcaggcgcagccgtatccgctgaacgccgcagctcgtcgaccaaagccttgaactccgcgtaattttcagtgacgccgacggcgttatatgtctggatatacgcgccgctgccccctgcgaacgccgtctcggcaacgacgcctgccgcaatacaccgcacaggatcggctgctatttcatcgagcacaccctttttgcgcaaaaaacgcagcgtattcggcgttttgtcagtgaccgcgaacgcgccgctgctggaaaaacgttcggcaccctcgggcgggaagtcggcggaaaactgaagattggcgatcaaggcgccctgcgggcgcgcgatttcctcggctgtccgggcaagaaggtcggcctgcatggcgtcaaagagcgcctgtgaatcagccgccggccagctcttttggacatatttgctgtcgtacgcgttggagatggtccatgaggtcacgtcgctgccgcggttaaagaacgcaggctgcgtctgtgcgagaaactcaggctgcgtctccagcgggagcagctccaaaaaggcgctgacgctcgcgccgtaatagctgcgcttgaccgtctgcccgtttttaaggcggtatgtgatatttgtatacccgtatacatacggatcgtcctccgggcaaatatccgaatagccttcgccttgttcgacaaccctctggtgaaacgagagcacacaatcgatatcctgcggctctttgagcagaacagagccgatgtactccgtttgaagcgcggcgggattgtcaaacggtttcacacgcaaaacgctggaccgctcgccgtcgacgccgttgtagctgatttcaacggccgataccccgccggcgtcaggcacgcgctgttcatacccaagaccgccggtgatcgggatcagagtcagcagagtaaccgcggccgtcatggcggcgccggccggcaatcgcctgacaagcgttttaaagccgcggttcagcacagcttccaacaccagataggtgagaaggccggcgattgcggtccacatcaccgtgtatggggcggcgcgctccgggtcctgcacaagataggtgaacagtccggccataccgccgcagacggccacgccaaacagcttgacgatgaactggagcacgccgcgggaagcagtcgtttcggcgatttccgtgcggcgcacacggtagagccggcgggccgccagcaggacgagcgcgccgatggcgagccagaccagcagggccgcgccgcttttggccgccatacggccctgttcaggtccatacgtcataccgtcaaggatgcgcatggccgcgagcgtaaccggcgagaggtagcccggcacgcgtatcccgccgccgctccagccgaacagaaacgagtctgccagcgccagcccgatccaggacacggccggcggcgcgacgagcagcgccccggagaagataaaggagtcgaacaccgtgccggtgcagacgcagacgaatgttgttacagcgtagatggcaaaggtacagacaagccatccgaacaggtcgagcagtaaaaagaacaggtggcttgggtccggcccaaaccggatcgcctgcatcacgccgacgagcagtgtagatcctgccagggggacagcgatgattgtcatagctgtcgccgcatggaccatcagcagcgtgccgcgtgtgactggcagcgcatgatagacatccgccgcttttttcgaatgcatatagctgttgaaggcgagcgccagtacaagcggtgcaagcaggacaatgggcgtgagaatcaggcccgtcaagatcgtataattttcagcgaaaccatacaggtgataattggtgatgttggcggcgtttgcgtccgcgcgcagtgatttgaacgcctccagagcgtactggagcggataaaagacggcgatgagcgccgaaagcagatacatatagccgcggctgcgccgcagagtcatgcggtacaggccgaaaaaacggccggactcagaaaagaatgctgttgtagtcataaccgaccgcctccatttcatggataaatacttcctcaagcgtcagcgggacgccctcggcaaacacggcgccctgcgcgagcagaaagccggcggcgctgttcgaggagccgcgcaccaccaggctgatcatgctgccgctgcgggaggactgcaaaacgtcaagcccgcgcagcgtttcgtcgctgacgccctgcgggaatactgcctgcactttacaaaagccgagacgcagctcgtcgatctcgcgctcgaacaggatatggccccggtgcagcaggccgacgtgatcgcacagatcctccagttcacgcagattatggcttgtgatgagcacggtcatcccatattcggccacgccgtcggagagaagcctgcgcgccgcgccgcgtgcgaccggatcaaggccgtcgaacgcctcgtcgagcagcagcagcttcggacggcaggcaagcgccagcacaagcgccgcctgacgcttcatcccctttgaaaacgtcgccagcttcgcggccggatcgagcgggaacacgccgagcaggcgttcaaaccgctcctgtgaataaccggggtaggattgggcataaaagcgcgccatatcgcgcaggctgctctgcggcagaaaatacaaatcgtccgcgacaaaaaaaatcgtctgcttgaccgcggtattttcatagactttctgtccgtcgacggcaatgctgccgccgtccggcatatagacgcccgcgcagagccgtaaaaacgtcgacttgcccgaaccattggagccgacaagtccatagacgctgccgcgcgggatacttgtggtcagagatgaaagcgcggtgaagtcgccgaagcatttgacaaggttttgcgcctctatcatacgttcgcctccttatagacatattcgaccgtttcgagcgcctgtgcgcgtgagacgccggcgcgccggccgctttcgagcgcgtcgcggattttctccaggctgcgcatgcgcagcgtctcgccggcgctgtcgccgccggcgatgaaactccccttgccggccatggaacagatgacgccgcggcgctccagttcctggtaagccttttggacagtattgggattgatgcccagatcgcgcgccagcgcgcgcacggatggaagctgctcgcccggtgcgagcgcgccaagcgccacaagctccgacatgcggtaaataagctgctcataaatcggctggcggctttgcaggtcgatggtcagcacgctgctgtcctcccttcgatcgattgtatgcagtgtactatatcacttagtacggtttgagtataccatatcccgcacgccgttgcaaccacttttttcatatggcggagggtcctttttaaagcttttatgaattttttccaataggtttgacagccgtgaaaatgatggtatactttaaaaagataattggcaaattgatttccttttccatgatgcgccccgcttgaagcggcgcatggggagggtgtgaggttggattttcatatgagaaaaacaaaaattgtctgtacgctcggccctgcttccgacagtgaggaacgcatcgcgcagcttatcagcgcgggcatgaacgtggcgcgcttcaatttttcgcacggcacgcatgaaagccatcgcgccacctttgaacgcatctgccggctgcgcgatcagatgggcgtccccgtggccacgctgctcgatacgaaggggcctgagatcaggctcggtctttttaagggcggaaaagcgcggcttgacgcgggaagccgcttcacgctgtgcgccggggagtgcgagggcgattcttcacatgcgtcgatcaccttcccggggctggccgcggatgttaaggcgggcggtacgattctgctcaacgacggcgcgattgagctgcgcgtcgcgggggtgcgcgagggcgccatcgaatgcgatgttgtcaacggcggcgtcatctccgatcataagggcgtcaacgttcccgggatccatctgtcaatgccgtatgtcagcgagcgcgaccgcgcggatatcatgttcggcgccgagatgggattcgattttatcgccgcttcgtttgtgcgctgcgccgacgatatccttcagatccgtcaaatcctggagcgtcagggcaatgaaaaaatccgcatcattgcaaagatcgaaaacgccgagggtgtgggcaacatcgacgacatcctgcgcgtcagcgacggcatcatggtcgcgcgcggcgatatgggcgtcgaggttccgtttgaggaggtccccatccttcaaaagatgctgatctccaagtgctataataccggtaagatggtcatcacggcgacgcagatgctggagagcatgatgcataacccccgccccaccagagccgaggcggccgacgtggccaatgcgatctatgacgggacaagcgcgattatgctttcaggggaaacagccgccggcgattatccgatcgaggctgtttccacaatggcgcagatcgccgagcgcaccgagcgcgacatcaactatcaaaagcggtttttcgcccgttcgggcgagcgtgtgcccgatatcacaaacgcaatttcacacgcgacctgcacgacggcttatgatttgggcgcggcggcgatcatcacagtcacctggtccgggacgacggcccgtatgctctccaagttcaggccggatatcccgatcatcgcctgcacgcatatgccgcacacgtatcaccagctcgcgctttcatggggcgtcacgccgctgctggctgacgttaagcagagcacggacgatctgttcgctcatgcggtggaacgcgcccaggccgccggttttgtgcgcgacggcgatattgtcgtaatcacggcaggcgtcccgctgggaattaacggcacaaccaatctgctgaaggtacatgttgtgggcgacatccttgtaagcgggcagggcgtcaacgggcgctgcgcgttcggcaggctgtgtgtcgcgcgcaccgacgaggaggcgctcgcgtcttttaacgatggggatatcctggtggtgccgcagacttcaaacgagctgctgcccatcatgaaaaaagcgtccggcatcgtaactgaacgcggcggactcaattcgcacgcggcaatcgtcggcatggcgcttgatatcccggtgattgtgtttgcggaaaatgcgacctcgattctcaaatcgtctacgatcgttgaaatcgacgcggccgccggtaccgtcagcaaccgcacacgcacggagcgggacggacagaaaaagggataacagccccgcggcctgctgccgcgcataagcgggctttcaggccggggcatatggaaaaaacatagggcgcgctgtaaaatagttcgctgcgcccagtataaaggagttcaggctatgaaacaagtacatgcaccgaaccgtttgattgcgctgctgctggctgtgaccatgctcctgtcggccgcggcgtgcggaggccgtgagacttctccggaggcaggcagctcgacgccgcaggacacgtcgtcgacaggcgtgcccgcatttgtcaacccgctcccggacgcagatctgtccgcggtcgcggagcctaaaaagcccgagggcgatcttcttgaaaagctcaacaccgcctacaatcaaaataacgatgtcatcggctggctcagtgtgcccgacacaacgatggacgatcctgtcatgttctgtgaaaacgacgccaacacgcagagcgatccggacccggagaacagaaacttttatcagcgccgcgacatcaacaagcagtacgattggtacggctcttattgggttgattacgagtgcaagcttggcgaccgcaacgagctttcgcgcaacacgatcatctatggccacagcatggatgacgatccggatgggctgaagatgtcgcagcttaaaaagtataacgatattgagtgggcaaaacagcatccgtacatttacttctcgaccgctgaggacgaaatggtgtggaaggtgtttgccgtttcaactgtcgatacaaaccttgcttacaaccatcccgacttgtccgacgccgattttatgaatctgatttcagagctgaaggaccgctccgtctatgatatcgatgtggacgtcaagtcgaccgataagattctgctgatctccacctgtacatatccgacaaactatacaaacgtccagctcgacgagagtacaaagtatctgatcgtcgcgcgcctgctgcgtcccggcgaggaggaaacggccaccgttgagatgaccgtcaacgaggatgtgaagaagccgcagtacaatttctgatctccgctctcttgtgggatcggtacggataaaataaaaaagcaggccgcgtccagcgcggcctgcttttttgttcagcggcggatattgcggccctttggggtttggccgggccgcggcgctttcggccgccggctcgttttgtctggcgcgggcgcggtgcgggccagcccgaagaaggcgaacaagtccgtgcggccggcgcggcgcagcgccgtctcgaccagacggcggttttcaggcttatagtattgcagcagcgcgcgctgcagctttttgtcctccggggcgcgcggcacaaagacctctttgagcgtgtaggggtcaagtccggtgtagaacatgcaggtcgagatgctgccgggcgtgggataaaagtcctgcacctgttccggacggatgcggtgttttttgagaaacaccgccagattaaccgcgtcgcgcagcgtcgaaccgggatgggaggaaatcagataggggacaaggtactgttccttgccgatctgtttggtcaggcggtaaaagcggtcggcgaattgttcgtagacctcgatatgcggctttcccatgcagtcgagcacatgcgcgctgcaatgctccggggcgaccttgagctggccgcttacatggtgctggagcagttcgcgcataaaggtgtcgtccttctcgagcatcatatagtcatagcgaaggccggaacgcacaaatacacggcggacgcccggaatttcccgcagctcgcgcaggatggagagatattccgcatggtcggcgcgcagcgccgggcacggcttgggcgcgaggcatttgcggtcggcgcaaagccctttggtgagctgcttttgacaggagggatggcggaagttggccgacgggccgccgacgtcgctgatgatgcctttaaagcgcgggtttttgacaaagcgtttggcctccgcgacaacggattcacggctgcggcaggtgacggcgcgcccctgatggaaggcgatggagcagaagttgcagccgccgaagcagccgcggttgtgcataattgagaattctacctccttgatcgcgtcgacgccgccctgagcctcgtaagagggatgatacatgcgttcgaagggcagggcgaatacagcgtcaagctcctcagtggtgagcggcggcatcggttcggtctgaacaagaaatacctcgtcggactgcttttggatgattttgcgtccgcgcacagcgtcctgttcgtccatgagcgtgcgcgtcgctttggcaaaagagagcttattgtcgcgcaccttggcgtaagaggcgactgatacggcgtctgtgggcaaatcaagctgatttgtgagatagcagacgccgcggcagcgaatcgcgcgcgccggcacgccgtccgcaagggcgcgcgcgatcagctccgtctgcttttcacccatgccgtaaatgagcagatcggcgccgctgtccacaagaatggagggcatgaccgtatcggaccagtagtcgtagtgcgcgaaacggcgcatggaggattcaagtccgccggtcacaatctgcgcgtccggatacagcgcacggattctgcggcagtagacggtcaccgcgcggtcgggccggcggcccgcgcggccgccgggcgtgtaggcgtcgtcagaacggcgccgtttggccgctgtataatgcgcgaccatggaatcgatgttgccgcccgtcacccaccagccgtattttggcgcgccaaaacgcatgtagtcgctgtctgtaacaggctgtgcgatcatggcgacccgatagccgagcgattccagcaggcgcgatacgatggcaatcccaaagcttggatgatcgacatatgcgtcgccggttacacagatgaaatcgggccgctcccaaccgcgcgcctgcatttcctgcggcgtcaggggtaaaaacataaacgtcctccttaaaaaacggccgccgcgtatgcggcggccctgcctgtatatggtcggaattattcctggcggttcagcttcatttcagcccagcgttccggagaaataagcacctgacgcggcttgctgccctcgaacgggccgacgatgccgcgcgattccatctcgtcgacaatccgcgcggcgcgcgcatagccgagcttgagacgccgctgcaaaagcgaagtcgacgccatgccggcttccacgacgcattcaatcgcgggcatgagcatttcatcctcgccgctgtcggcatccgcgttttcagaggccgcgccgccacccttggagccttttccagcgacaacatggctgtcgatttcctgcacgattgattcgtcatatgcggcggacgaatcgttcttgataaacgatacgacgctttcaatctcctcgtcggtgacaaagcagccctgcacgcggatcggtttgggagcgccgaccgggctgaacagcatatcgccccggccaagcagcttttccgcgccgcccatatcgagaatggtgcgcgagtcgacctgcgaggacacggcaaaggcgatgcgggaagggatatttgccttgatgacgccggtgatgacgtcgacggaggggcgctgcgtcgcgataatcagatgcataccggctgcgcgcgccatctgcgccagacggcagatataatcctcaatttcgttcggcgcagccatcatcaaatcggccaactcgtcgatgatgatgacgacctgcggcattttttccataccttcagtacgttcggcaaggtggttaaacgatttcaagtcgcgcacggagttatcggcaaacagcttataacgcttgagcatctcggtaacagcccatgacagcgcgccggcggcttttttcggatcggtcacaaccggaacgagcaattgcgggatgccgttataaacgccaagctcgacgacttttggatcgatcatcagaaaacggacctcgtccggcgtcgaattaaagagcagggaaataatgatggaattgatgcacaccgattttccggagccggtcgagccggcgatcagcaggtgcggcatttttccgatgtcggcaaccgtgacattgcctgcgatatcgcgtccgagtgcaacagacagcttgcttttcgcttcggaaaattcgcgcgcgtcaaggatttcacggatggaaacggcgctcacgaccttattgggcacctcgatgccgacggcggccttattgggaatcggcgcttcgatgcgcacgcccgccgaggcgaggttgagggcgatgtcgtcggcaagcccggtaatccggctgattttgactccggccgacggctgaagctcataccgtgtgaccgccgggccgcgtgagatatcgacgatgcgcgtctgcacgccaaatgacgcgagcgtgtcgacgagacgctgcgcattcgccttcatctcctctgtgacatccgattcgcttgtacggcgcgcctcatgaagcagggagagcggcggcttgcgataggccggcggtacgggctgcggctccggttcggcgggagggtccgggacatgcgcctgttcctgccccggcccgtcccatagagcagcatccggggccggctcctcaggcatggcgtcaggttcatccggtggatcgtcgagaatcggcggcagattgatgaccgtaccggacacggcgccgctgtgcggctcctttggcatggtgaagctgtcgaaagagggcgtttcttcagcggagaaggagaaacgccccgtatcggtcgcagcctttgtcacaagctcgtcgatcgacggctcaggagcggcgacaaactgcatcgcctcgtcggccggcatcagggagaatccggattcccgtgccgggtcgaacggctcgtcaagcgggatatcaatcgacggctttggatggtgcggagcatccgcacgcgccgccgctgccggagcctgcggctccgagtccgcctcggcggacggctccggcgtggccggagccagcgcggcgcccgtgcggtcttcgccctcaagcggaatatcgatgcgcgccggcctgcgctggcgcgcaggctttggcggcgcggccgcgcgggcggcgcgccgctgctcctggcgctccatctggtcggcgtacgtctcgccgatcttctgcacgggcttatgcgccgcctggacgatgccgatcagcgtgccgccggtcgtcagcatcaggaacacgaagatcagaagcacgatgataatacccgcgccgagcttgccgcagaacttgagcagtggcacgccaaccagcgctccgaccaggccgccgcttttgacgtcgatgcccgccacaatacattcaacaagcatttcaaggatgttttcatcagcggactgcggcatacccatcacaaagatttgaagcgacgcgcagaaaaaaagaattaaaaatccgcccatccaggcgcgtcccttgacaggcttgtccatcgtaagcaatgccgctatgtagatcagcaggacgcacacaaagatcgcgccccagccgaacagaccaaacagggcgttgtgaagccaattccaggcgcttgcgccagaaacgagcgtcagcgcgccgaccagcacgccgactgcaaacaggattacagcctgcatctggcgtttggcgcgcttttgagcggcattgcgcttgcgcgcagcggcgctgccgcctttgccgcgcgaacctgattttggttttgctgccatgataacctcctcaaaacacgggctgttggcaagctcaggcgttttgccgacagccaaagggtagaagccggttttgactcagccgatgaaaaactgctgaatcgcatggccggtaaaattgtcaattgttccaatgatgagtacagccgtgccgagcgcaagcgtataccagccgaaataacgcagcttattgcccttgacgacccattggaccagtttgatggccagcacgccgaataccgcagagctgatcaagccggtcaggatcacaggcagcgggagcgtcgtcccttcggaaacggcgtcggggatttcgagcacgatcgcgccgagcacggcgggaataccgagaataaacgaataagacacagcgaattcacggcgcagtccccacagcataccggtgcagatggtcgagcctgaacgcgaaatgcccggcattgtcgccacaacctgggccacgccaacagcaaccgcatccttcgccttcatattggaagcatccttgcgtccgcggtcgtgacgcgaggcccaggtcagcaggatgccggtgaacaggaaacagagtccctccacggtgacgtcattgtctgtggaaaacgcggagatgcgatccttgatgagcaccatcaaaaacaatgggcagacagacaacagcaaaaacagaagcatacgccgctcgggacgcatatcgcgtgtggagaagcggcgtgaaaaaagatcgccgatcagagaaaacgcttcggcgatcaggctgacgatcgtccgccagaatacgatacatacagcgatcagcgtaccggcgtgcagcaggatggaaaagacaaagcctgtttcgctgttgttgccggtgaaatactgaaacagggagagatgtcctgaactggaaacaggcagaaattccgtcagtccctgaatcaacccctgaaaaaacgcttcaaaaacactcataattggactccttatgtatggggcgccgcgggcgtcccgttattcctgttttgcaatacgccccccgggggcatagcgcggatcaagatacatttttggatcggtggagatcagccgcgaaatagtaaatactccattcatatttacgccctgtataaaattgttatgcatacggcgacattcgccgccccggggcgcatcgccgggaaagatctgctcgggcggaatgattgtatgcaggatcatttgacatcaccctcgatcatctcataaagcgccgcaatgacatcggacacgccgccgagcgaatcgatcagcccttcgtccacagccgcctggccgtcaagcacggtgccgacgtccatgaccagctcatccttgttcatcatgagctggcggaagcgttcgggcgaaatacgcgagttatccgttacaaatttgacgatgcgctcctgcatccggtcaaaataggagagcgtctgcggcacgccgagcacaagaccgttcatacgcactggatggacggtcatcgtggcggacggcacaataaagctgcgccgcgccgatacggcgagcggtacgccgatggaatggccgccgccgagcacaagcgaaacggtcggcttgcgcatcccggagagcagctccgcgattgcaagccccgcctcgacatcgccgccgacagtgttgagaatgacgacaagcccttcaatttcagggtcctgctccaccgcgagaagctgcgggatcacatgctcatatttggtcgtcttgttctgtgcgggtaaaatatagtgcccctcgatctgaccgatgatcgtcagacaatggatcacatgcttgcccttgctggcggtgacgccgccgatctgaatgatttgatcggtctgctcaggcgagccggtttcaaactcgtcaggggtgccctgaggcgtatccggctggttgttatcaagctttttcaaatcgtttcactccctatcgaactggtaacgattttagcattgacaaatcttcgcccgttatgccttgcacagaaagaagcggcccgctgacgaagcaggccgcccgcgccgcaatcctgtctgtatttataatagcgcagcggcaatgaacccgcataatctggttcaggctgtggcgcaatatgcacagtccgctggttttttagtttgcagccgccgggcggctgcaaacggctttgccgtttgcctgtgtatattatagcatctttgccttcggcggacaagggtcaatacgcaccgccggcggctgaaatcagaaccggcgccccggctttggcggcgtcagtgcgcctgcacggcgcgcgcaatggcggcaaactgctccatggagagctgttcggcacgcgcgccggacggcacgccggcgcgcgcgagcagcgcggacgtattgcctttggacaggccaaggccgcttgaaaggcagttgagcagcgttttgcggcgcatggaaaaggcagcgcgcaccactttgaaaaaaatggcgggttcgcccgcgtcgacagccggcgcgctgcggatatccaggcggatcacagcagaatcgacatccggagagggaagaaacgaaccgcgtgaaactgcaaaaagcatatgcggctcgctgaagtagcgcaccgctatggacacagcgcccacgccgcgcgtgccgggctgcgcgcaaaggcgctgcgcggcttctttttggaccataaccgtgaccgattggacgggaagacgctgttcaagcagcgccatgacgaccggcgatgtgatgtaatacggcaggttcgcgcagacgacgatatccagcccggcaaactgttcagcgatcaacgcatgcagatccacctgcaaaacgtcggcgttgataatctttatattgtcaaaaccggcgagcgtttccgcaaggaccgggagaaggcgcgcgtcaatttccacgcaaacgacacggtcggcgcggcgcgcaagctcggcggtcagcacgccgacgcccgcgccgatctccagcacgccgacgcccggccgtgcgccgccttgctcggccatgcgcgggcagacggttggattgatcaggaaattttgcccaagagccttggaaaatgtaaatccatgccgcccgagcacatcgcggataacgccgatgttggtcaggttgtccatcgcgtcggtcccctttctgcatgagacgccgtaaaaaacagttgcgccatacatgaaaacagcgtaaaataggaaaaacagtaaaagatcatttgtttattataaaggatgtggagaaagatgacaagacgggacaaaattaattattacctcgatatcgctgaaaccgtcgcggagcgggggacctgcctgcgccgaaatttcggcgcgattattgtcaacaacgatcagattgtttcaaccggctacgtcggagcgccgcgcggccgcgagaattgctccgatctgggctattgcacgcgcgagcggctcaaggtcccgcgcggggagcggtatgagctgtgccgttccgtgcacgctgaaatgaatgcgatcatccatgccgcgcgcagcgagatgctcggcgcgaccctttatctcgttggacgcgaggtttcagacggaagctatgtgaaaaatgcctgcccctgctccatgtgcacacgcctgattatcaacgccggaatagcgacggtgattgtgcgcgacgacaaggatcattacagggtcctggatgtttcgtcggaatggattgagaacgacgaatcgctgcgcggcatgtccaactattgagggatgcgaatggaaaaaagacagaaaacgccccggatcgatccgacggcgcatgtcgcgccgggcgcggtcgttttgggggatgtgacgcttggggaacaggcgtccgtttggtacaacgccgttgtgcgcggcgatgtcgagcgcattgagatcggcgcgggcacaaatatccaggactgcgccgttatccatgcggacagcggtttcccggccgtgatcggcagcggcgtcaccgtaggccacggagcgattgtgcacggctgtcaaatcggggacggcacgctgattggcatgggcgcgattattctcaacggcgcgaaaatcggacgcggctgtatagtcggcgcgggcgcgcttgttacacagggcgccgtcgttcccgacggcgtgcttgcgcttggcagccccgcgcgggtgcgccgcccgctcaccgcacaggagatggatgcgaacagacgttccgctgaacattatgccgcgctttcacaatccctgtaaaagcagcgggaccggaatcatatccggtcccgctgctttcatattatttttgattttctgtcttaggatacgcttcattaatctggtaggacaatgtcatgaggctgtcgcccagatgaacgttttcaacgatcacgccttcgaaatcaagcgacagatcgtagtgggaaaagttccagaagcaattgacgccaagctccatcaagcgctgtgtcgtctcaaaggcaacctccttgggtatgcacagaacagcggcgcgcggcgtgtgcgcacggcagaaatcttcaagctccgccgcgtcgcggacgacaagatcgcggatcgtctggccgacaatatgcacactgttgtcaaaaattccgatcagccgaaagccgctgctgtcaaaatccatatggcgcgcaatggtgcgtccaaggttgcctgcgccgatcaaaaccatcggcatgtggcggtcaagccccataatgttgccgatctccttatgcagcgcagccacgttatagccgtaaccctgctgtccaaacccgccgaaacagtttaaatcctggcgaatctgggacgcggtgagctgcatcatctgggcaagctcccgagaggaaatacgggtaacgccgcggtttaacagctctccaagaaagcggtaatatcgcggcagccgcttgataacagacaatgaaacgccttcacgcttaggcaatcagaaccaccttcctttcgcgtcctggcggtatatttcaagacccgcccgcatcggaccacgcaaaaaacgcagccgcttcttacagacgcgcgaccgtgtccataacataattaccaaattcctcacaggtgcagccggtatcgcggcctgtgacagtcagcttcttttcctcatacatacagatatcgagcgcccgctcgagcttatcggcctgttcctgatacccgatatggctgagcagcagcacggaagcgcgcagcatggaacagggatcggcatatttgccgcgcccctctgaaatcatccggggcgccgaaccgtgaatcgcctcaaacatcgcgtagcgtttgccgatgttggcgctgccggccgtgccgacgccgccctggaattctgccgcttcgtctgtaataatatcgccgtacagattcggaagcacaaacacctggaaatcacggcggcgcttttggtcgatcagcttggccgtcgtaatatcaatgtaccagtcgtctgtcgtgatctcgggatattccttgccgatctgttgacagagcttaagaaatttgccgtcggttgtcttaatgatgttggcctttgtgatgatcgaaacgcggtttttatggtttttgcgtgcataatcatatgccaggcgtgcgattcgctcagtgccttcggtcgtggtgacgacaaaatcgaacgccagctcgtcgtcgatattgattccgcgcgaaccgaccgcatagccgccttcggtgttttcacggaagaaagtccagtcgatgccttcgcccggcaccttgacaggacgcacgtttgcaaacaggtcaagctccttgcgcatggccacattggctgattcgacattcggccagggatcgccggcgcgcggcgttgtggtgggaccctttaaaattacatggcactttttcagctcggcgagcacgtcgtcaggaatagccttgtgttgggccgcgcggttttcgatcgtcagaccgtcaatcgtgcaaaattcgatcctgccgctttttacgtcgtcggcaagcagatgctgcagcacgcgcgccgcttcatttgtgatgatgggaccgatgccgtcgccgccgcagacgccaacgatgatcttgtcaagacttttgtaatctgtaaattccttttcggctttaatccgttcgttgcgctcgagctgcatctgcacaagcgctgcgaatttttcagcggcttctttgattttctgttccaattgcatttccccctgtcggtttattgaacgaacagcttattatgataattttataacaggcagtatcaattgtcaatcaacaggagaaatttgtccgcccgcatcaggcaaggaacaaaccggcgtccatacagaccgccgccatgtcctgcattgtgcgccgcgcggcagccagccggcggctgacggtcgatggatggatgccaagctgccgcgcgatggcactgcggcttttccccttaaaaaaataaagctcaacaacagaccgctgccgctttggaaggcagcgtaccgcgctgcgcgcaaagcgcgcgtaccgcgcgcgcacggctgagttgtcgccgcctgaatcgccccacagcgagcctgcgaagtccgcgtaaaaaaagccatccatggaccgttcagacatggcggcttcccctttcatccggctcataataatgaagcagataggcgcgtacagcgcgcagctcggtcagctcggcgcgcatcgtttcaatacgccgctgaagcgaaaacgcctcctctccacgcgctgttttaagaagcgcacgcagctctgcgagacgcctggaaagggcgtcggctgctgtgcggtattcctcggaccactcggtaaaatacataaaatccccctttgcatgcttggacagtttttgctttttggggcaaagcccctcttatctccaaagtaacatgcaaaaaggcgcacagcaacgaaagcggcccgcgatactgaaagtggaatgatgcgcgcaaccaactgttcattaaatgggactatatgcggcggatgggcagaccgtggacggcggcgcggcctgtaaaagcgaatcggccgtcccactgttcgcggcgcagccgaccaaagttttttgccgagctttttttaaaaaagcgggaagcaggagcctgcaaaatccgcgtccggccgcatggcgtttgtcacggattttgcttggggcaggcggagcgccccagcaggattcttgcggcctgcgggccgcgtttttatgaaggctgcggcccgggggaagggcgctgccctcgaaaaaaggcaagacccgcgtggggccttgccttttttctcacccgccgccttttaaaaaaggcgggcgaaaacttttgatcgacgcggcgtaaaaccagattacgcagcgcccgccccgctgttcgcggcgcagccgactaaagttttttgccaagctttttttcaaaaaagcgggaaaagttcaaaggaggcttcgatgccggtgcaggcgagcgcctggccgtttgtatctgtaaagcaggcaagctgtgcagccatgtatgtcccggctgggagcggctcctcatagatgtcgagcgggacctgaattgtgaccgtttcaccggcgggcaggatcagcgattcatccggctgtaaaacggctgtgcgcggcgtcagtgggatgacctgaccatcctccagccggcggatgtcaaacgcatgggtgtaaagcagatcgctttgcgagttgtttgtaacgatcagctcaatctgcgccgtcccgaccggatagcgatcggccgcgcgcgcatcgacgctgccctgcgcgccggcgctttccggaaggggcagcccgtttttcggcggtggtacttccgcgctgccgtcattcgcgccgggcagaccgatgaccgtcgtgaaccggtcgttcgccgcttcgggcaaaaacaaatccttttccccggcggaagcggttccggaggatgaggggagggaactggccgcgctcgacgccggcggctcgcttgatccgggcggcgcggacgaaaccgccgccgcgccgccgttctgtgccgtgcagcctgtcaaaagggctgtacagagcagcagcgcgccaaaggcgcgcggcatactaaacattaaaccggaacaggacgacgtcgccatcctgcatgacatagtccttgccctccgaacggacaagccccttttccttggcggcggccatcgaaccgcacgccatcagctcgtcaaatgagacgatttcagcgcggataaagcccttttcgaagtcggaatgaatcttgcccgcggcctgcggcgctttggtcccctttgtgatggtccaggcgcgaacctcctgcttgccggcggtcagataagagatcagcccgagcagatcatagctctttttgatcagacggtcgagccccgattcatgcagccccatttcttcaaggaacaaaagcttgtcctcgggcggcatatcggtgatctcctcctcgatctttgcgcagatcggcagcacctcggcgtgctcagacgcagcgatttcttcgacttcgttgtagaatttattcgattttataccagatgtaaaatcaaattcactcatatttgcggcatagatgaccggtttggccgaaagaaggggcatatcgtcgagcgcggcgcgctcctccccgtcgcaatcaaagctgcgcgccggctttccctcctccagatgcgccttaaggcggcgcagcgtatccgcctgcgcggcaagcgccttatccccgcccttggcggccttgagcgaacggtcgatcttgcggtcgacaatatcgatatcggagaaaataagttcaagcccgatcgtttcgatatcgcggcgcgggccgatctctccgtcgacatggacgatttcgccgtcctcaaagcagcgcacgacgtggacgaccgcatcgacctcgcggatgtgtgaaaggaacttgttgcccaacccctcgcccttggacgcgccgcgcacaagccccgcgatatcgacaaactcgataacagcgggcgtgaatttatcgggatcgtacagtttggcgagcgcgtcaaggcggctgtccgggacagcgaccatgccgacattcggctcgatggtgcagaacggatagttcgcggactgcgcgcccgcgttggtaatggcgttgaatagggtggacttgccgacgttgggcagcccgacgatgccaagcttcatggattttgaccctccaaaacgccggatggcgtatattgatggcacactgcggctgaaaataacaggacgctatggttccctcgccggggaacaagccgaaaacggtgattgacggccgcacgaccggtcccattatacaccaaaatctctcaagcggcaagcgcgcgcaattaacggcgcgtgcatgtcccgttcaaaaaatattcaccaaaagaggtgattttattgtataatcgtggtaggatataaaaaggagctttggacagccgtgctgtaaggcgggctgccggtaaaatcaggaaggggcgccgctttttggcgcgcggcccggcaacaacgagggggaagcgccgtgtcaatcggaaaaatcctggtctgtgacgatgaccgcaatatttgcgagctgctgcgtctttatcttgaaaaggatggctatacggtttcaattgcaaatgacggcgaggaggcgctcgccaaatttaccgctgaagcgccggatctgattttgctcgacatcatgatgcccaagcttgacggatggcaggtctgccgtgaaatccgcaagaaatcggactgcccgatcattatgattacggcaaagggcgaaacgttcgacaaggtgctcggcctggagcttggctccgatgattatgttgtaaagcccttcgaccccaaggagattgtcgcgcgcgtcaaggcgatcatgcgccgcgcgagcaagtcctcggcggaaaacgacgtcaaggaggtcgcctatgacaagctcgtcgtcaatatgacaaagtatgagctgaaggtcgacggccgcgtcgtagacacgccgcccaaggagcttgagctgctttatcatctggccagcaatccaaaccgcgtctacacgcgcgaccagcttcttgacgaggtgtgggggttcgagtactacggcgacagccgtaccgtcgatgtacacatcaaacgccttcgtgaaaaactcgagggcgtgtccgatcagtggacgctcaaaacggtctggggcgtcggatataaatttgaagtgaaggaatagggcttgcctgaaagactgttcagacagctcaaaatcaggacggcggcccgataacgaacccggttcgttatcgggcgctttccgaaaaggcggttgaccgccggccgtccggagaggaagcgttccatgcagaaaaccttatttagtaaacattttatcacagtggcggcgattatcctgctcagcatcacaattctcggcgcggtgctgcttgcatttgcgacgcagtattttaagcaggaccgtttccgcctgctggagcacaacgcgcagcaggcggcggagctgacctattccgattttcgcgagaaccggtatcagggcgtcacagtggccaaggtgctgccgcgataccggatcgtggccgatgcgatcgaggcggacgtttatcttgtggggatcgacggctcgatcaagctgctgaccagcgggacggacggcggctataacgatatcgccatccccagaaagatcattgaagcggctgtttccaagggggagtatcaggagcttggaaggatgggcggtctgtacaacgaaaagcattacaccgtggggattcccgtttcaacggaggagggcgtcccggcggccgtcattttcgcgtctgctcccgccgacacgctgatggtgtttttgtcggaaattctcaagatgtttgtcgtaagctccctggctgttctgattcttgcgtttgcggccgtttattttatcacagccgatctggtgcggcccctgcgcaaaatggtcgcggccacgcaggcgttttcaaagggtgatttcaccgtgcgcgttcctgtggagagctacgatgagattgggaagctggcgatttcgtttaacaatatggcgacctccctggcgaccaccgaggtgacgcgccggtcatttacggccaatgtctcacatgagctgcgcacgccgatgaccacgatcgccggctttatcgacggcattctcgacggaaccataccgcccgaaaagcgcgacgattacctgcgcatcgtttccgacgaggtcaagcgcctttcgcggctggtgcgctcgatgctcaatatcgcgcgcatcgaagcgggcgagctacagatcaagcccgacctgttcgatgtcaatgaaacggtcatccgcacggtgtttacctttgaaaagccgcttgaggaaaagggtatcgaggtgcgtggccttgataacggcaaggtcatggtcgaggccgatccggacctcatccaccaggtggtctataacctgatcgaaaacgccgtcaagttctgcaacgaacacggctatatcgaggtcagctaccgagccgacgacgcatatacctatgtgggcattaaaaacagtggcgatgggatcgccaaggatgagatcccgcacattttcgaccgcttttataaaacggataaatcgcgcagccgtgaaaagggcggcgcgggacttgggcttcatatcgtgcgctccattgtcaacctgcacggcggagacatcgttgtgcgttcggtcgaaggggaatactgtgaatttgttttctcgattccaaagccgcagaagggaaagaaggcgcagcaggcgattgccgccagcagtggaaaaatgtaaaagcttattcacaatcgcttcaacggttttcagtaatcttttcaaaccgcgtctattttatcttaacatttttccggtatactaacgtcagaaaacaaaaagatgcatcaaaaacaatccggaaaggtctgacgatctatgaatgataattataatccgaatcaaaacgcgccggacgagcaaaaccggcaggacaatggcgcgcacgacgccaatgcagggccaggcggacatgtctggaatgtgccgccgcaggaaggaactggcgattaccgtccgccttattattccgaagcgggcggccagtctccgcggacatcccagccgccgcagcagtattcggccagcgacggttggcagagccgcgacggacgtgacgtgcacggaaagacgccgtatcagtggaatttttcagaatatgaacaagcggcgggggctgccaagccgaagcgccgccgcggcctgatggtgtttggcatcatcctgggttccgtgctggtcgtttcgcttgtttcctttgcggggatcggtatttacagcaccctgagccgggtgcccgcgccgtccgctccggcggcggatgagccgacgctccaggttccggcggacaacctgcccggcatcacaattcagaataagcccgagacggccgaggaaatactgcccgacggcaagctgacaagcgagcagatcattgaaaaggtttcgccctccgttgtggcgattaccacatatgtcaactatcagaattaccaggccgagggtatgggcagcggcatcattatccgcgaggatggatacattgtgacaaacgcccatgtaattgaaggcgccaagggcatcaccgttcagctcagcgatggaacgtcgtatgagggccgtgttgtcggcagcgatacgcagacagacctggccgtcattaaaatcgacgcggccggcctgaccgccgcggtgttcggcaattccgatcaggtgaagatgggtgaaaaggtccttgcgatcggcaatccgcagtcgatggcatttgtcggcagcgcgacgcaggggattgtttcaggcctcaaccgcgaggtgactgccggcggtcagaacggtacggctgtcacgcactataccaatttgattcagacggacgcggcgatcaatcccggtaactccggcggcgcgctcgtcaacgagtatggacaggtcatcggcatcaattccgccaaggtcgccgcgaccggcgcggagggcatgggctttgcgattccgtccaaccaggccaaggagatcgttgacgatctgattgcttatggccgtgtaaccggccgtgtgcggcttggcatctatgcgatcgaggttgacgaggttcttgcgcgtctcaaccacgtgcccacagggctgctggtccagtcgactgaggaaggttccgacatctccagcaagggcgtcgtgcccggcgatatcatcaccaaggtggacggcacagaaattgccggcaccagtgatttgtcagaggtgatcgagggtaaaaaaccgggcgatacagttgaactggaggtttaccgtccaagccagcgtccaaatggcgaaggccgcttcttcaatatcacagtcgcgctgatggaagatatgggcgataccactgcgcagcagccgcagactcagcaggttccgcagcaggaacaacagccgtctgaggatcaatattataacgatatggaggactttttcaaccgctttttcggctgatatcctctccctgcataggaccggtcccagcgccgtgtgcggcgctgggaccggtctttatgaatttgccggcgaacgcctttaaaatctgaaaaaacagccgagaaatcataatttgtttacaattttggtgtatactgtatctgtgaaatgactgcggctgtgagccgcaaataatgcaacgttttaaaggagaccgctatgaaacagcagcagccgtccgtttatcatacgcttgtcctcgtaaccgatcagttcgcgtgtgaacgcatcattaaggccgcgcgcgtgatcgccgatttgtcaaaaacaaaccttcttgtgctcagcgtaatgcgggatggcgtctgtacaaaccctgctgcgttggagcatctgttcggcgtcgccaaggagtatggagcgcagatgacggttgaattttccgataatccgcagagcgcaatcacacattttatccgcaataacagggtgatcaacgcgattactggcatgccgaacgatgaaaattcgattcttgtccggatgtggaaaacgctgcgcaacgtgacattttttactgttacggaaaaaggcgagctgcatgaggttgtcgaccgggaataccacaaggatattgtgaatacgatcgtatgaaccttcaaaagatcggaggatgcatatgaatattacggttaaacagattgaatataaaagctccgcaacgggcaatacgattttcggctggatttatattccggcggagccggcttgcgccgcggtccaaattgttcatggtatgtcggaacatatggagcgttatcatgagctgatgcgttttctcgcgcagaacggctatgtggcatgtggaatcgatcagctcggtcatggacgctcggcgcctgacgaggagcatttgggcttcttcgctgaacaggacggctggaaacgcctgatcgacgatcagcacaaatttgcgcggattgtccacgcggaggcgcccggtctgcgcacggtgctgcttgggcacagtatgggttcgtttgtttcacgtatctatgcctccaaatattcgcagcagctcggggggcttgtgctctgcggtacagggcgcggcgatccgcgtcttggatttgcgctggcggcggcgcgccgctcaatccgcaaaaacggtccgctttaccgcgaccgcagtctgcataagctggtgttcggccattataacgaccggtttcagccggtgcgcacaggcggggagtggctttcgcgcgatgaagcctccgtcatgcggtattccgatgacgcccgctgcggctttacatttacggccgccggttttcacgacctgtttatgctggtgcgcgaaagcaattcggccgcttgctttgaaagcgtgcgtaaggatctgccggttttgatcctgtccggcgctatggatccggtcggcgagtttggaaaagggccgcagacagtctgccgcaggtaccgcaaagcggggcttgagaatgtgcagatcaagctgtatgagggagcgcgccacgaaatcctcggggaactcaaccgcggccaggtctggagcgaccttctcacctggctccggcctttttgaaaaaaggcctcggcgaaaaactttagccggctgcgccgcgaacagtggggaaggccccagtttttttacaggctgcgccgcgaacagcggggcaggccccggttttttgcaggctgcgccgcgaacagcggcgcaggcgcttcataatcggtttttacgccgcggcgatcaaaagttttcgcccgccttttgaaaaaggcggcgggtgagaaaaaaggcaaggccccttgcgggtcttgccttttttcgagggcagcgccctggtccttgggccgcggccctcataaaagcgcggcccgcagtccgcaggagcttgttcaggagcagggcttctcgccagcaaaatctgtgacagacgctgtgcggctggcacggatttttgccttgcgagccaaaaaaccatccgtcaatccagacgcgttgagatgttgtacaggctcttagagcggcggcgcttcttttttggagagctgttcgatcagctcggcaaaaaacaggaacaggaaacacacggcggccatcatgatcagcggaagggcgatgccgacgagcgaatagaacaaagatacttccagagaagcggagctttggaactgctggccggcttcaagcagcatctgcatctgctgtttctggttgaaatagctttggaaggtcaaaagcacctgacagagcaggtagaggaatgtgagcacaagtcctgcgatatgaacgcgataaagtgcgcgcgcggtgcggttttcaaaacgggcgcggcgcggcggcaggtccagctcgtccgagggaaccgcctttgcaagcaagccgccgccctgctcctgtggagtttgatccgtctctgtgggcgcggcggcctgcgcgtccgcggcagtctcctggatcgtgtctttttcaagctccggcatcatgcctcatcctcctttgtttgataaagtccggttgaaagatagcgttcgccgccgtccgggcagagcgcgacgatcagcttcccggcattttcaggccgctgcgccaatcgccgtgcggcggcgatagccgcgcccgagctgacgccgacaagcaggccgctgtccctggcggcgcggcggctggcttcaatggcgtcctgtgtcgcaacggtgacgatctcgtcgatcacggaacggtcgaggttttccggcacaaaattggctccaattccctggatgccgtgcttgcctgcgcgtccctcggtgacaagcggcgattcggccggctcgacaccgatgacacggatggccggattggccgccttgagcgcgcgcccaacaccggagacggtgccgccggtgccgaaggacgcgacaaaaagatcgacgcggccgtccgtatcgcgcaggatttcgcgggcggtcgtcgcctcgtggatggccggattggccgggttctcaaattggcgcggcataaacgcgccggggtgcgcggcggcgatctccccggcttttttgacagcgccggccatcccctcggcgccgcttgtcaaaacaagctcggcgccgagcgcggcgagcagcatcctgcgttcggcgctcatggtttcaggcatggtcagcacaagccggtatccgcgcgcagcgcagacaaacgccagcccaataccggtattgccggaggtcggctcgacaacaagcgcgccgggtgaaagcgcgccgcgcttttcagcgtcggcaatcattgcaaaagcggcgcggtccttgaccgagccaagggggttgaagtattccagcttgacggcgacacgcgcgttttgcacattgcttaagtacatcagcggcgtatcgccgataagctgtgtcagattgtccttgatattcatcgggttcccttctttctccggcagcgcgccggttggtatgtggggattcctttttctattatacacccgcgcgtcatcgaatcttgaacaaaaagaaaatattttgtcatgtaaagaaaaacaccttgacatcttgcgccgctccctgtataatacacagaagggaaatgtgtaaagcaatgcgctttacagaaaggagcaggatcgtggcgaagaatctggaaatttccgtactgcttgatttttacggcgaaatgctgacggaaaagcagcgggatgtcgtggaattgtattataatgaagacctctcgctttcagagatcgcggcacacagccagatcacccgccagggcgtgcgcgattccatcaagcgcgccgaaggaatcctgctcggcttggaggagcgcctcggcctggccaagcggttccgccgcattcaggaggggttggatctgattatccgcgatgcgcgcgatatccgaaattacaacgaccggttcggtacgttccgtgaaattacagataaaacaaacgagatcatcgaaattgcaagcacgatcaacgactgaccgcgatcaattcttggtcaaaagggggtggcgcagtggcgtttgaagggttgtccggcaagctgtcggcggtctttaaaaagatgcgcaacaaggggaagctcaaagaaagcgatatcaaggaagcgatgcgcgaggtgcgcctcgcgcttttggaagccgacgtcaactacaaggtcgcaaaggattttgtcgccgccgttacggaaaaagcggtcggggacgaggtgcttgaaagcctcacgccggcgcagatggtcgtcaagatcgtcaacgacgagctgacaaatctgatgggcgagacgggcgcgcgcttgaatttttcaagcaggccgccgaccatcgtgatgatgtgcggcttacagggttccggtaaaacgacgcattcggccaagctggcgctgcattttcgcgaacagggcaaacgcccgctgcttgtcgcgtgcgacgtgtaccgcccggccgctatcgagcagctcaaggtggtcggcgaaaaagccggcgtcccggtgttcgatatggggcagggcgacccggttgagatcgcgcggcgcgcggtcatgcacgcgaaggaccatggcaacgaccttgtgatcctggatacggccggccgcctgcacatcgacgaggcgctcatggacgagctgaaacggattcgcgacgaggtgtcgccgcaggagatcctgctcgttgtcgacgcgatggtcggccaggacgcggtcaacgtggcctcggcgttcgacgaggcgctcggcatcagcggcgtgatcctcacaaagcttgacggcgatacgcgcggcggcgcggcgctctccgtgcgcgccgtgaccggcaagcctgtcaaattcgtgggcacgggtgaaaagctcggcgacctcgagccgttttatcccgaccgcatggcgtcgcgcatcctcggcatgggcgacgtgctgacgctgattgaaaaggcgcagagcgattttgacgcgaagcaggccgccgagatggcgcagaagatgcgacagaacacatttaatttcaacgacatgctcgcgcagatgcagcagcttaaaaagatgggtccgctgtcgagcgtaatcaatatgctgccgggcgttgccggcaagctggacgacgaacaggcggagcagggcgagcgcgagctgcgccgcacagaagcgatcatccagtcgatgacgcccgcggagcgcgaaaagccttcgctgatcaaccccgcgcgcaagcgtcgcatcgcggccggcagcggcacgcgcgtcgaggacgtcaaccgtctgctgcgccagaacgaacagatgcaaaagctgttccggcaggtgtcgggcggcggcaaaaagggcaagcgccggcgtatgccgttcggcgggatgccaccgggcatgggcggcgggatgccgccggggatgccgttttaaaaggttcgccggttttccggcttgccgatagaggtttgtcaataatcataggaggtgacataaatggctgttaaaatcagactgagaaggatgggcgccaagaaagccccgttctaccgcatcgttgtcgcggattcccgttatccgagggatggcaggttcatcgaggagatcggtacgtacgacccgacgaaggatccctccgtcatcaaggtcgacgccgaaaaagcgaagaaatggctctccaacggcgcgcagcccacagacacggtcaaggcgctgcttaagatcgaaggcgtgctctgatgcgcgtggaggtgatccgttgtggataagctgattgtcacgatcgcgcggggacttgtcgaaaacaaggacgccgtcagcgtcaccgtggacgagccgaacgaggaagggctggtggtttaccaccttcacgtcgcccccgacgatatgggacgcgtgatcggcaaacaggggcgtattgccaaggcgatccgcactgttgtccgcgctgcggcgaacagggccgaccagaaggtcgccgttgagatcgactgaaaaaggggggcgcagcccctcttttttactatggacataacccatccgtgggatgggcgggcagaaggagcaagcatgaaaaaacagtatttggaatcggggaagatcgtcacaacgcacggggtgcgcggcgaggtgcgcgtacagccgtggtgcgatacgcccgatttcctcacacagtttgcgtgcctttatctggacgcgcgcggcagtcaggcgcgcgtggtggagcgcgcgcgcgtgcataagaatattgtcattgtcaagttcgagggcgtcgaaaacgtggaggacgctgcgagcctgcgcggaaaaaccgtctatatcgaccgcgcggacgttgagctggaagaaggggagtgctttgtgcaggatttgatcggctgtactgtgcgcgacgcggatacaggcgcggattacgggcaggtatacgacgtgcgcgccaccggcgccaacgacgtctactatctgcgcgacgcagcaggccgcgaacgccttgtcccggcgattgcggacgtggtgctcgcaaaggatctcgacgccggagtgatcacgatccgtccgctggagggattgttcgatgattaagatcgatttggcgacgctgttcccggcgatgtgcgagacggtgctgtcggagagtatcatcggccgtgcgcgcaaggccgggtatcttgacatccggtgctttcatatccgcgattataccgtggatcgccaccgcaatgtcgacgacacgccctatggaccgggcaaggggatgctgatgcaggccgacccgatgtaccgcacctgggaggcggcctgcgaagcgcgcggcggccacaggccgcatgtaatctacatgtcgccgcagggcaggacgctgacgcagcagcgcgcgcgggagctttcgcagatggagcatttgtacatcatgtgcgggcattatgagggcgtcgatcagcgtgtgctcgacgagattgtcgacgaggaaatttccatcggcgattatgtgctgaccggcggcgagcttggcgcgctcgtgctgatcgactgtgtggcgcggctttgcccgggcgtgctcgcggatgaaagctgctacgagcaggaaagccattgggacgggctgctggaatatccgcagtatacgaaacccgccgtctggcacggcgtggccgtgccggagattgtaacgaacggaaaccacgcggcaattgcgcgctggaggcgcgaacagtcgctcaaaacgacgtatgaaaagcgtccggagcttctgcgcacagcgtcgcttacagaaaaagacaaatggtacctgcgcacgattggctggaccgacgatccggatgacggcagccggacgggctgaagcgcacgcgccctctttttcgacaggatgccccggctatgttgacataattgttgaaaactttatggttaagttgcacaatcgtgctttgaacgcctggcagcgtatctggaaaagcaacagaaaatacggccgggacaagaaagaaaagcaaaaattgttgacgctttcccgcaatccgcttataataatactaacacacaccaatcagatcagtttggagctgactcctggacaaatccaaagcgccgtttggcggaggggttttgtttatggatacgttccgattatggaagcagaggggtattgaaatgtttgtcaaagaagtcgctgttcagaaccaggttggcctgcacgcgcgtcccgctacgttctttattcagaaggcgaatgaatacaaatcctccatctgggtcgaaaaggaggagcgccgcgtcaacgccaagagcctgctcggcgtcctgtcgctcggcattgtcggcggcacgtcgatccgtatcattgctgacggctccgatgaacaggccgctgtcgagggccttgtcaagcttgtggagtccggctttacagagtaaaaccgtttgccgctgcctgccgcaaacggtccgcgccgcattgggcgcgcgccatgcagattcgcatgtatgtgtttgaccaaaaacccccttgccgggctgcggccccgcggagggtttttagtcgttccccgcgcttttcggggacatgcggacgggcgcgcggccggcggcgcgttttttcaaggcttgccccgccaattttgatgggaggtggacgcaatcgacaatccgcgtctttcgtttctggccgaaaaggcgcgccggcttccgcttttgccgggcgtctacatcatgaagaacaaaagcggcgagattatttatatcggcaaggccaaggcgctgaaaaacagggtcagcagctatttccgcacggtggaaaagcaccatcccaaggtgtacaaaatggtcagccatgtatacgattttgactccatcgtaacggacagcgagttcgaggcgcttgtgcttgaatgcagcctgatcaagcagcacacgccaaaatataatattctgctcaaggacgacaaaggatacagctacatcaaggtggcgcccaggcagtacgggcgtatcacgcatgtattccagaaggaggatgacggcgcgcagtatatcgggccgtatatctcctcgttcgttgtaaacgagacggtcgacgaagccaaccgcgtctttatgctgccgacctgcggcaaaaagtttccgcaggagttcggcaaggcgcggccgtgtctcaattatcacatcaaacggtgcatgggcgtctgtatgggaaaaatttcgcctgaagcatatgatgaaattttggagcaggcgctcgattatatccgcggcggcagcgcgcgtgctgtcgagcgtctgaccgagcaaatgaatctgtgcgctgaaaacatgcagtttgaaaaggccgcgcagctgcgcgaccgtatccgggcggtgacgcgcatcagcgaatcacagaaggtcgtatttgcgaaggtagccaatcaggacatcatcgcgctcgcgcgcagcgaaagcgagacgtgcgccgtggtgctcaaattccgcggcgaacgcctggtcgacaagcaggactttttgatcggtgcgactgatgatatcgacgccgcgcgtcaggaatttttgctgcgctactatacgacgcggcgcggcgatctcccgaagaagattcagctcgacggcgacgttgcggatgtgcagcttgccgcgcgcctgctctccgagcaggcaggctataaggtggaaatccatatcccgcagcgcggcgaacagctccggctggttgagatggcgcgcaaaaatgctgtcgagcgcctttcgcagaccgtgcgccgcgcgggacgcgaggtgggcgcgctcgacgaattggcgaggctgcttgggctggaacgtccgcccgcgcgcatcgaggcttatgatatatcaaacatcggatcggacacggtcgtcggcggaatggttgtctttgaaaacggacgccctctgcggcgctgttaccggaaatttacgatcaagacggttgccgggacggacgattacgccagcatggcggagatgatcgggcgccggttcgcacattataaaaacgacgagacgccggacgaggcgttcggccgtctgcccgacctgatattgcttgacggcggacgcggccatgtcggcgccatcgcgccggtgctcgcgtcgatggggatctccgtgccgctgttcggcatggtcaaggatgataagcaccgcacccgcgccatcgcccaaagcgggggggagatcgccgtggcgccgcaccgcagcgcattcacgctcgtttccacaattcaggacgaggtgcaccgttattccatcagtttttcacgcgcgcgccatcagaaatcgtcttttgaattgtcgctgaccaaatgcgaggggatcggacaaaagcgcgcggctgaaatcttccgccatttcaagacaatcaaggctatccgcgcggcggacgtcggcgcgctcgccgcggtcaagggcgtgagccggccggcagctgaaaagctttatgaatttctgcatgcggatgattgacaaaatggacgaaacaggcaataatatgcatacaagaccgcccgccgagggcggttcagacgggaggaacggctatgagggtgatcacgggtacggcgcgcggcacgcgcctaaaggcccccgaggggcggcagacccgccccacctcggacatggccaaggaggctgtgttcagcatcctgcattttgaattggccggcgcggctgtgctggatctgttcgccggcagcggacagcttggcatcgaggcgctctcgcgcggcgcgaaaagctgtgtgttcgtggaccactcgcgcgctgcgcaggaggtcatccgccgaaaccttgcggcggccaagctcgcgccgctcgcgcgtgtggccgcgatggacgcatcatcctttttagcgggatgccgcgaccgcttcgatattgcgctgctcgacccgccgtatgacggcggccagttggaaacggcgcttgcgggcgtggccgcgctgatgaacgacggcggcgttatcgtctgcgagacggaccgccgcgccgagctgccagccgtggttgggacgttttgtatacaaaaggcgtaccggtacggccgggcaaaaatcacgacctatagaaaacgacaggaagaagatgactgatatggagcgtctggcgatctgtccggggagcttcgacccgattacaaaaggacacgaggacatcatccggcgcgccggaacgctgttcgaccgggtcatcgtcgtcgtcagctccaatccggataagcggccgattttttcgctggatgagcgcgtcggcctgatccgggatgtgtgcggcgatatgccgaatatggaggtcgacaaattcagcggccttctgattgattatgtgcgcgcgcataaggcggttgcgattgtgaaagggctgcgcgctgtttccgacttcgactatgaatttcagatggccctgacaaataaaaagctgtatccatacgctgagacggtttttttgacgccaaacagcgataatatgtatctaagctccagcatggtccggcagattgcgcggtttgggggcgatgtcggcagctttgtgccggcggcgatcctcgatacagtgacagaacgcctgcgcgcgcagtatgcggctgttggaacaacgagtgagtaaggaggcgtttccccaatgaatatcgatgagattctggacgtgatcgacgagctgcttgaccgcgcgtggagcctgccgctttcgggcggccgctgcgtggtggacgcggacaaggtgcgtgacttgatcgacgacatccggttgaatattcccggcgagatcaagcaggcgaaggcgatcgtatcagaccgcgccgagatcatcgacggcgcgaaaaaggaagctgaacagatcgtgcgcaaggccgaggaccgcgcccgtgcgctgatcgcacagcaggaggtcacaaaggcagcgcaggccaaggcgtccgagattctctcccaagcgcagatcaaggcgcgcgagatccgtcaggccgcgcaggaattttccgacaactgtatgctcaagactgaggaagtgcttgtcaagtccttgaccgagatcaaggcgacccgtcaggcgttccgcaacgctacatcccgataagttttccgtgtttttgaaaaaagcctcggcaaaaaactttccggcttttttgaaaaaaagcctcgccaaaaaactttaatcggctgcgccgcgaacagcggggcagccgctgcgtttatacaggctgcgcctgccccggggttgggtccacgggataggggcggtttgacgatttgtcacagaacgcaccggcgtgcgcccgatacgaccgcgccgaacagaggcggggataacataaggggagggccgccgccccgccccttgtgaggcgcgaaaagaggcgcggccgcggcttgtccgcgcccggcgctatagcgcagggaagccccgaatagccggccgggccagcgcaggccgcgagagcctgctcagacgcagccatttccatcgacaaaatccatgacagacgccctgcggccggcgtggattttgtaggcgcccgtcttccggccatttcaaaatatgataccatgcagcctaagcgttgtcattgcattgtttaatgcagtcaatgagaacgtttgttctttttgtggattgcttttttttaagtgatcgtgtataataaccgcagggcggttattataccgggctatgtccagggcgatacgcgggcgcggcccgctgccgcctcgatggccaattgtacaatgccgctttcgcggacattgtataatatgcgcagggtaaacggctttgccgtttgcagccgccattcggcggcagccgctgcgaaggcagcgggctgcgcatggtacgccacagtcgaaaccggcgattttaaaagggtttgctgctgtggtataatatgggtattacatacggcggaggtcacatgcatggcggataaggacaaaaagctcggttcagtaagcgcacgcaagagcggcgtctcatccgaggatcggaaaaaggcgcttgagacggcgcttggccagattgaaaagcaatttggcaagggcgcggtgatgaagctcgggcaggacagtacgctcaatgtggaggcgatctccaccggctcgctgtcgctcgatatcgcgcttggtatcggaggcgtaccgcgcgggcgcatcatcgagatatacgggccggaaagctccggcaaaacgacggtcgcgctccatgttgtggcgcaggcgcagaaagaaggcggctcggctgtattcatcgacgtcgagcacgcgctcgacccggtgtatgcgcaggcgctcggcgtcgatatcgactcgctgctcgtttcacagccggataccggtgagcaggcgcttgaaatctgtgaggcgcttgtgcgctccggcgcgatcgacgtcgtggttgtcgactcggtagccgcgatggtcacaaaggccgagattgagggcgatatgggcgacagccatgtcggcctgcaggcgcggctgatgtcgcaggcgctgcgcaagctgaccggcgcgatcggcaaatcaaactgcgtcgtgatctttatcaaccagctccgcgaaaaaatcggcgtcatgtacggcaatcccgagacgacgcccggcggccgcgcgctcaaattttacgcgtcggtgcgtctggatgtgcgccgcgtcgaggcgctcaaaaacggcactgagctgatcggcaaccgtacgcgtgtcaaggttgttaagaataaggtgtcgccgccgttcaaagaggctgagtttgatatcatgtacggcgaaggtatctccaaggtgggagaaatcctggatcttgcgacaaagctcgatatcgttgtgcgcggcggctcgtggtttaattacggcgaaacgcgtctggggcaggggcgcgacaacgccaaggaatttttaaaagccaatccggaaatcgcgcaggagattgaaacaaaggtgcgagagaatgccgacaagctgttgaagactgcgaaaactgccggcaaaaagccgatgcgcgccggcgcttcggccgcggagccggaaaagctttccgccgcgccggaggcgccgtccgcgcccgcgccgcgcgtcaacattgacgtggagacggacgacgaatgacgctgactaaaatcgcgatgacaaagcgcggccgggtggcgctgtatgccgacggtgcgtttgtgatgagcctgcaccccgatgtctttgcggcatcggggatttcggtcggctcgcagattgatgaggacgccctgcgggagctgtcggacgcagccgagctgcgcgaggcgcgcgaacgtgctctttcgatgctttcacgccaggattatacggcgcgcggtctgcgcgaccgcctgatgcggcatgtgagcgaagaagcggctggacaggctgtggagcgtatgcaggagcttggactgatcgacgatgagcgctacgcggcgcgtttcgcacaagagctttcagagcgtcgccattatggcgcggcgcgcatccggcaggagctgcgccggcgcggcgtcgattcgcagacagccgccgaggcggcggcatatctggaggggaatgatccgcaggcgcatattttggcggtactcctgaaaaaatatccgcaggcggccggggacgaagctgtccggcggcgcgcctggggcgcgctgctgcgccttgggcacagcccttccgatgtgcggcgcgcgctcgacgcgttctgcggcgggcgcagcggatttgatgacgattgacgacataatttgacacggggcggcgcgcctgtttgcgctgcttcggatgctgcaaaggagctggctgcatgtcggtaaaggtcgggatggtatccctgggctgttcaaaaaatcaggtggacgcggagcggctgctcgcgcagattgaaaaaggcggctatgaaatctgcgccgacgcgtcgcaatgcgatgtggttatcatcaatacatgcggcttcattgaggacgccaagcgtgaaagcatcgaaacgatcctggagtttgcgcagcttaaaacgggcggcgcgctccgggcgctcgtcgtaacgggctgcctggcggagcggtatcgcgagcaggtggccgcggaaatcccagaggcggacgtcgtactcggtatcggctgcaacgcggacattctcggcgcgattgaaagggcgctgcacggtgaaaaaacggtggcgttcggcgagaaggaggcgttgtccctggaaggggagcgcgtgcttgccaacgagccgtattttgcatatctcaaggtggcggagggctgcgacaaccgctgttcctattgtgcgattccgctgatccgcgggccttttcgcagccggccgatggagaatatcgtcgcggaggcccagcgccttgcggcgcgcggcgtcacggagctgaatgtcgtggcgcaggatacgacgcgttacggcgaggatttgtatggacatctggcgctgccggaacttctggaaaagctgtgccggctggacggcgtgcggtgggtgcggatgctgtactgctacccggaccgcatcacggaccgtctgctcgacgtgatggcgcgcgaggaaaagatcgttaagtatatggatattccgattcagcatgtaaacggacgcattctgtcgctgatgaaccggcgcggcaacgccggaagcctgaccgcgctgatggaaaaaatacgcgcgcgcgttccgggcgtcgtgctgcgcacaacgctgattacgggttttccgacggagacgcaggaggagtttgagcagctgtgcgaattcgtgcagcgcgtgcgctttgagcggctcggctgcttcgcctattcggccgaggaggatacgccggccgcgttgatggacggccagctcgacgaggaggaaaagcgccgccgcgcgcagatcattatggagcagcagtacggcgtcatggaaggcttcaaccggtcgcagatcggacggcggctgaccgtcgccgtagagggacgcgagggcaggctttggtatgggcgcagctatatggatgcgcctgatatcgattcgcgcgtctgtttttcgggacatgggccgtacagcccgggcgattatatagaagttgagatcgacggcgtggaaggatacgatttgaaagggaaggcgctgaacaaatgaatttgccgaataagctgacagtcatgcgcatggcgctgattccggtgtttctcgtttttatgctggcggagtcggtcccgcaccgctatctgatcgcggccgtcatctttgccgccgcgtcgtttaccgattatcttgacggacacatcgcccgccgcgacggacttgtcacgaatttcggcaagctgatggacccgctggccgataagctgctggtgttttcggcgctcgtctgcttcatcgagcttgagatgagttccgcgctcatcgtgttcatcattctggcgcgtgagttccttgtgacttcggtgcgcctgatcgccgccgagcaggggaccgtgatcgccgccgatatttggggaaaaatgaaaaccgtgtcgcagatcgtctgggtgctgatcgctctgacggcgctctggctggaggagagctggccgcttttcatgacagtctcccccggtgcttctgcgccgcccgcgccggtgatctttctgatcggcctgtcgtttgtcatacagacaatcgttgtgatcctgacggttttttcaggctttaattatatctggaaaaaccgttcgcttcttggcgatatcaaataacgcttgcatccgcgcctgtgttgtggtatcctcaaatcaatacagctcgtattatggaattcacttgcaggttcagttcttatcagaaaagagaatttttctatgaaaacatatggtatgctcttggcagctttcgtgcttgcggtttgctgcattgcctgcgttgcacaaccagcaaacccatctgttccaggagctttatccatgccagcttcgtcatctgccgcctctgcattggaaagcgaggcggggcagtcaaaagtgattgaggtcggcggtgaaaatctttacgatacttttgcagacctctggttcaaggcaaactgtatttacgatgtggaagactttacttttctggaaaaagccggttcttgcgactttggaatcgggcctgaattttacgaaattaccaactatgacacagtggttcccacaatattcagtgcgaaaggaatcaaacaactggagcaggcaacaatcggcagtgataccgtcacatttatccagaaaaaggatggaaaaacatatcgtttaggtccttggaaaactggatatgcttatcaaaatgcactggaggatatccgcctgaaagaagccttcgataacaaggtaattctggaagtgcagtacaggcaattccccggctatgcaggagcggaagaaaactctgattatgtcttggaatatgcttttgttgattttacagtggtcaaagaaaatgggcagtggctggttgaggactatatcttcccaggaaatagaaacactgggacggcacaggacagctttcaaaaatccggtgaaagctgatcttacgtcccagccgcaggggtttttacaatatcgccagcccttcaattcaaagcggtgcagacctttgcgaagtttcccattggaatagactcgttttgaaattgtttatgcacagaccgcctgccggccgcatagactgtatagcataaatgcgttgatcgggagaagtatccgcgaagccacgcgacagagaagacgcgccgaaacgccgcgcccgcccaggcgggacggcgccgggctgcaagcgcgtcccgcgcgggccgcggcgaaatgcgcccgtgagcacgccgtccgaacggtttatatccgggtggggcggcgcgtttccccgcgttaaggggtatggggtggacgcccctgagtgataaaccgaagtggaaccgcgggaatgccgccttcgtttggccttgggccggacggggcgtattttttttcctaggggctgtttgaaaaatcggaaataccgtctttttctacaaacagcggtgaatccagcgttaaaaagcctcggaatccgaaagggttcctgtgttttttgccttgtattctcctgctgtctgcgaaaaatccggcaattcctctattttcaaacaagccctaaagacgggcttaaaaaatattcctgcgcattcatgttcttctccaaaggaggtatcataaggatgtttgacgaactgaaaaaggatatacaggcggtcaaggagcgcgacccggccgcgcgcagcagccttgaggtgctgctgatctcgagcggcctgcacgcgctgatgctgcaccggccggcgcattggctttacctccacaaggcgtttttgcccgcgcgtttgatcagccaggcggcgcgctttttgaccggcgttgaaatacacccgggggcgaaaatcggctccggcgtgatgatcgaccacggcatggggattgtaattggcgaaacggccgaggttggagacggctgcaccatttaccagggcgtgacgctcggcggaacgggcaaggataaaggcaagcgccatccgacgctcggcaaaaacgtcacggtcggctgcggggcgaaaattctcgggccgttcaaggtcggcgacggcgcgaaggttgccgcaaacgcggtgctgctcgaatcgattccagcgcaatcgacagcggtcggcgtgcccgcgcgcgtggcgcgcgtcggcggacgaaagccaacgacgcttgaccacgttcacattcccgaccctgtggcgcaggagatctgccgcctgcgctttgaaatcggtaagatggagcagcgcatccgggaattggaaaagaaggagcaaaaacaaacgcaggagcctatccatccgccgcgggcagccgcggcggatgagcggtaaaacgcgcacggggcctgcgccccgtgtacatactgcgcgcggcatgggcctgacagcgtgcggccgggatgccgcggaaatcccaggtcttgccggtcagttcatttaggaggaaaagatatgaaaatttttaatacattgacgcgtcaaaaggaagaatttgtcccgattgagcctggaaaagtcaggatgtatgcctgcgggccgaccgtttataattatatccacatcggcaatgcgaggccgatctgcgtgttcgatacgctgcgccgttatctggagtatcgcggatatgatgtgacgtttgtgcagaactttacagacatagacgacaagctgattaacaaggccaacgaggagggcatcacagtccgcgaggtcgccgagcggtatatcggcgaatatatgacggatacaaaggggcttggcatccggccggccgatatccacccacgcgcgacggaaaatatcgacacgatcatcaatatggtcaaaacgcttgaggagaagggctttgcatatgagcgcgacggcagcgtttatttccgttcgcgccgctttgaggagtacgggaagctttcgcatcagccgcttgaggagcttgaggcgggcgcgcgcatcgacgtcagcgacaaaaaggaggacccgctcgatttcgtcctctggaaagccgccaagcctggcgagccgagctggccgtctccgtggggcgagggccggccgggctggcatattgaatgcagcgcgatgatccgccgtcaccttggcgatacaatcgatatccactgcggcggccaggacttgattttcccgcaccatgaaaatgagatcgcacagagcgaatgctgcacaggcgccgagtatgtgcattattggatgcataacggttatatcaacgtggataaccgcaaaatgagcaaatcgctcggcaattttttcactgtgcgcgaggtggcggagaaatttggctatgagccgatcaagttcatgatgctccaggcgcattaccgcagcccgatcaattacagcctcgaggtgatcgaacagtgccgcgcggcgctggagcgcctgcacaactgccgcgacagcctcgatttcgcgctcgaaagcgcgctcgggcaaggggactggcacgcgttcagggagaagatggacgcgcgcgccgcgcagtttgtcgaggcgatggacgacgacttgaatacggccgacggcatcgcggccttgtttgaaatggcgcgcgatatcaacacatatatcgcacagccgcagccggaggaggctgtcgcttatgcggtcaaacggtttgacgagctgtgcggcgtgcttggcctgctttataaccgcgcgtcaaaggatctcgacagcgaggtcgaggcgctgatcgccgagcggcaggcagcgcgcaaagcgaaggattttgcccgcgcggacgcgatccgagatcagcttgccggaatggggattcttctgaaggatacgccgcagggcgtacagtggagcaggaagtgacggcggtccgcgcttgtcccccagcgggaaacgcgcggcgttggggcgcatggaggcgtgctgaaaggcccaaacttgtatggagggccgtttaaaagagcaaagctgcacaagggctttataaaaacaagtcctggaggctgaaaggagaacagcatgcgttttgaacgaatccgcgatttgcgggaagatcgcgatttaaaccagacagccatagccaactatctggcgatcgatcagccgggatattcgtgctatgagcgcgggatacgcgacattccaattgagattttgatgaagctggccgatttttatgagacgagcgtcgattatttaattgggcgtaccgacgtttacaggccatatcccaaatcgcatctgttatgaaccgtgcgtttcataccggcgcaatcgcctgggcatgcgcggcatttctgtcggtatcgtttggagccgatccgcgcgcggcagcggctgttggagcgttcatgctgctggcggctatcgccgtgagaaaaaggctgccgttgtggctttgcgccgcgacggtagcttttggtctttctctggtatggctggcgctgcacagcagcctgacgttttcggccgccgcgcgttttgaaggcgtttcagtggatttgcgcgggttggttattgaacgtgtggaatatggcgattatgcgcgtctgacgctgatcgcggaggacgggccgctgccgtcaggaattcgcgtgtcggtcggggcgcccggcgcgcttgatgtttcccccggcgatgtggtagaatgggaactgataacggacaggcccgatgcggcgtcgcgggcaaagctctatgcagacgcaatcgggcttgaggcatccatggccggcgcgccgcggctggttggaaaacgtccgaacgactggcgcgtcctgttcgcccggtaccgcgacgcggccgcttcgcatatcacacgatatctgactgggccggagggcggcgtgctcgccgcgatggccacaggccgcagcgagctgatcgctgcggatctccgcgcagattacgcccggtcgggcctttcgcacctgttggccgtatcgggactgcacctgaccgtgttcgccgggctgttcgacgcgcttttgtcaatcgtccgctgcggacgccgcatgcgcgcagccgccgggctcacggccgtgcttctctttatgctgatgaccggctgcacgctttcggtcgtgcgcgcggccgtcatggctgtgatctgccgcacggcgctgctgctcgggcgtgattcggacacgcttaattcgctaggattcgctctgatcatcatcctgctgcaaaatccatacgccatattcagcacgggcttgcagctttcctatcttgctaccatggggatcgccgcctgcgccgatcccgcctgcgcgtggtgcgcacgctggatttggcggatggacgcgcgcagcctgcgccggctgcacccattgggttatgcggcgcttctggccttttcaacctcagtctgcgccggcgtgtttacagctccagtgctttgctttgcattcggacagctctcgcttgttgcgccggttgcgaatgtgctggccgctcccttcgtaacgcctgcgctggcgggcggtctgctctgcggcctgctcggctttatcccaccgcttgacgttgtggcgcgcgcctgcgcgctggccggcggcgcatcaattcgtgtaatcaacacgattgcttcctggtggggcgccctgccgtttgcgtctgttccggtgcgcgccgggcttgtgacgctttggatgggcgcctgtattctgggcggcgccctgctcgcggcaaatcgtgcgccgtatgcggtgcgtatttatgcggcgtctcttgcggttgtggcgctgctgtccgggatgctggcgcatgccatagcatggggaccgaccatggaactggctgtttcgcagagcggtacaagcgtcgcgcttgcctgcggcggacagggcgctgtgatcggggagccggagtctgtctcggatgcccagaatttggctgcatttttaaaggacagcggcgtgaagcgaatttccctttatgctgtgcaggaggagggcgcgcttttctccaacaggacgcacgcactgtcaaaaattcttccggtcgacacagcgttcggccttgaccggacgcacggctttgcggcagagctgcccggcgcgcgcatttcggccgaggggaaggatgcggagagcatttcgattgagatgggcgggcttcggattgtcaagacgtttgaccagatacctgcggccgccgacgtgctgatcaacgcgcgcggacagattgtcgccgcgcccggcgtcatgctgaaaacaaccgcgcgctattacaactgtgaaatcttgacgctgcgccgcacaggcgcggctgcgctggacgtgataccgcacgccgcggcgcgtctgacggagggaacgccttgaaatatacgatggaaagcgattttgcaaagcatgtcaaaagcagcgggcagcacaatgtctacctgctttacggcgggcaggcatacctgatcgctctttatgaaaaaatgatagtgaaaaaggcgcttggcggagcggatgaagcgttcaatttgcgccggttcgacggcgatacgctcgatttacaaacgttttacgatgcggtcgaatcggtcccgctgatggcggcgggctgctgtgtgacgctttcgctcgatccggaaaagctcgatatgagccgaatgaaggagctgtgcgccgtgatcggcgacccgccgcagacgacggtcatcgtcgtcacagtcaaggagccgcccgcacgccgggaaaagatgaatctgctcatcaaggcgtgcgacaaagctggctgtgtggtcgagcttggcagccggcgcggcgcggacacgctgcgctttctgcgcgaccgtgcgcagaaaaacggctgcacgctcgaaagcggcgaagcttcctatatggtcgaacgctgcacggacgatttacagcttttggccacggagcttgataagctgtgcgcttatgcgtccggccgcaaaattacgcgcgcggatatcgacgccgttgttacagtcgttttacaggcgcgcgtattcgatctgtccaaggcgattctgcgcggcaatttccccaaggcgatggagctgatcagccagcttgacgatttgcgcgagccggctgcgcgcacgctgtcgatcctgtcgggcgcgtttgtcgatttgtaccgcgggtttgccgccaggcaggcgaacgtgcccgccgggcgcgcggcccctgagcttgggtatgccaaaaaccgggagtttgcgatcaaaaacgggatgagcgacagcggcgcgtataccgccggacagctcggcgcgatgctcgaggcgctggccgaggcggacctgcgcgtcaagagcagcggcggcgacgaccgcgtcgtgctggaggaaacggttgcaaagctctttttgatcggcggtcgtcagaaatgctgagggtacgccaggctattatcgtggaagggcgctatgataaggcgaagctgcattcgctcgtcgatgcaaccatcgtgacgaccgacggcttcggcgtgttccgcaaccgtgaaaagctcgcctatatccggcgtctggccgcgcagaccggaatcatcatccttaccgactccgacgcagccggctttcgcatccgcggctttctggcgggcgcggtcgacccgtcgcaggtgacgcatgtctacatcccggacttgtttggaaaggagcgccgcaagacgcagccttcggcggagggaaagctcggcgtggagggaatcccggcccagacgctgctggccgcgctgcggcgcgcgggcgtcgctgtggaggaaacgtccgcgccggccggcgcggggaaggcgtcctctgcggacgccagcgcgcgccggctgaccaaggccgattttgtggcctgggggctgtccggaggggcggacagcgccgccaggcgccgcgcgctgctttcgcggctcggcctgccggagcgtatgagcgcaaacgcgatgcttgccgccgtcaatgcgctgtatacgcctgaggaattcgaacgcctgcttgccggtatgccggaggaaaagggaacgcattgcgatttttcggatcattcaggacaaccataaaccaaaggaggtcgccaagcgcgtgcagatttacagcctgtcgtttctctatttatttttgccggcggccattttattgtgcctgtttgcgccgcaccgtgcccgcgcggcagcgttgcttgcagtgtcgggtgcgttttatgcgatgctggagggcgacaatctgctgctggcggcagcggtgattgccttcgattacggtatggggcttttgatggagcgcagcgcgtcctttgcgcgcctgcgccgtgcaattatgatctgttcagtggtcaaaagccttgcgatccttgttctttacagtctggcgcaagagatgacaggcgcgcacagcccatttgggctaggcgtcatctgcctgacctcttgcggatatgtgatggactgttattttggttatacgtattgtgaacacagcctggtgcagcttgggctgatgacgctgttttttccaaagctgtatgccggaccgctcgtctatcacagtaaaatagtcccgcagacgcgctcgatgcgtatgacccttgaaaaaaccggcgagggcgcgcggtattttttgcagggtctggcgaaaaaggtgctgattggcgacacagtttacaggctctatgagacgctgcgtgcgctgccaatggccagtgtgacaatggctgctgcgtggacgatggtcgtgacgctggcgttttcggtctattttatcctcgcgggtttttgcgatatggcgcgggggcttgcattgatctttggtttcgagcttcaggataattttcatgcgccgtttggatctaccggcatcaacgactttttttcacgtttcaatatcacagtcaaccgttatgtgcgccgctatgtttatatcaatcttggcggcgcgcagggcagcgtgatttcaggcgttttcaacatcctgctggttacgattctgatggggctatggtttagcatcagcctcaacctgcttttgtggggcgtttatttcgcgctgtttgtgatctttgagcggtactgtctgggccgccgcattgatctgattccgccgctggtgcgctggatttacagcacagtggtaatcatggtttcattttgctttcttgcgggcgatacgccggggcaatcgatttcttacctgctgcgtctgttcggtctgcgggggaccatttcgccggaaagtggaagcagcatcctgtatctgttggcttcgaactaccttgtgctgctgatagcggtcttttcatcgaccggcctgattgaacgggcggccaaggtgatttataagcatgcgccgcggctttactggtttgggacggcggtgctgacggcggcgctgctcattgtgacaacggcgtttcttgtatagaggctgattgaaaaatcaaatgttcgtctattatcaaacaagccctaaaaaggtttgaccggctttgaaaggaggcggaagcttgcttggtaaaaaattgacgggaacggtgtttttactcatgctgttcgcggttccctgtctgatcgcggcgggcggcggggggcgcgcgcttttgcgtgccgccggttcgatttacgcgccgctgggcaagctggaaacggcgatggccgaacagttcccggcggccgaccggctgcgcaagctggaggtgtccttaagctacatgggcgggcagaaggagcaaaacggcgttttcatctccggcgattctctgacgcttgatgtgcagccaaaaagcctgtcggtcatcaacggcaatacgcttgcaatgatcgattttgccgatgaacatcaaataccaagttatgtcatgctgatcccgacggcatgtgccgtccagcagggcaaggttccctatgacaaagtcgcgccgctttacaaccagcgccaattgatcgacgacgtataccgccgcgtatcaggccatgttaccgccatcgacgtttatccaacgctctttaatcatcaggatgaatatatttattataatactgacaacacgatcaccggcttgggcggatattatatttatactgcggcagccaaaaatttgctgcgctccaacccgcgcgggcttgaccaatacgaagtggagcatctggattacaattattacggcgatctgtatgcgctgtctccttaccgggaggtttcagccgaccgtgtgtcggtatactcctatgtgtcgcgttatcagcgcgattatatcgtcacgcattacgacgcttccggtatccgccggtattatacgctgtatccgcgctttcgggcggagcttgacgattcgatgggggtcgtgcttggcggcatgtcgccggtgatcgatatcagtatcatcggcagcacgacaaacagcaaacggctgctgctgtttggcgaccggtcggttcagggttatctgccgtttttgcttgcccattatgagcgcgtcacggttgtcgatacaactcaggctgcacccgagcagctcgacaggatcaacctgcgcgattacagtcaggtgctgttcgcctggtccgtcgaccactatgttacagccgatcagctttccttattggacagccttggcgcggcgcaggaagcttgaaattgcgcgcaggccgccctgcccgcgcgcgggatatttcaaaagagacggggaaaaatatgaccggtatgggagattttctccgcgttttcgtatgatgtaaggtccggtcaggcaaactggcttgctcggaccttgtatcaaatcatttgggaggcttccgctttatgaaacaaatcgccgcactgcttcttgcagccgttctggctgcttctatggccgcctgcacgggaagaaattcgttggcaacgtcctcggcgctctccgaaggggcggcttccgccgcgacgtcctccgaaccggcgccgcaggcatccggcacgccttccgagtcgctgctgtcatcagcgccgcagacggacagggcggggctggagcgtactctgtatatcggcgccggcgcttcaatgaaggaatatccgtggacttttgaaagcgatccgtcgcccgacgatctgattgccgccatcgccgagatgaccggatggaacctgacgctggccgaaccggtcagcagcggccgcggcggcatgacggttgtttttggccgggaaagctctgttttcacaggtccgcccgctccgcagaaggatgaattccatgtgttcgatacgcaggatctggtattccatatccttgacagcatccagaaaaccttgcagatgaacacgatcgatccggcgcttggcgatccggacaaccttgatatctatttttcgacggaggacggagctatatcgctgcccgacgtggggattgaaatcccgttggaggagccatatccgggttctgccgcattgtctgaaacgtatgcgcagagctgatcagaacgaaataaaacgctgtgggcgcattccatttggaatgcgcccacagcgttttggtgtgatgcatacgcaggatatgtgccggccgcgcatatcctgcgcaatctaaaaataagagagaaatgaaaagcaaacaaaagcttattaacaggtttgaatacaggttcttaaacaagctccatatccatcacagccttgatctcagaaccgccgtcgcgcagcgactgcataacgggggcgatctcattcattgcaaatatgtgtgttataaattgctttggatcgatcacacctgttttgatcagatcggtgcacatcgggaaataaagcgccggagctgcgaaggaagcgcgcagctgcaactttttaaagtgaaacgcattggcgtcgaaggtgatcatacgatccggaccgtaatcgatgccaagaaagctgatgacgccgccaaagctggcagactcgatcaagtcgggaatgacctttggcggcgcggtgacaaggatatggtcgacaccgccgcgcgggaagggataattcgacagcggggtgcgcccggtaatgacgacatcctcaacgccaagcgcacgcgccagagaaatgcgccgcgcgctgcggtccgaatgctgcgccgcgtagacgcgcgcaccggccgcttttgcaagccgcgcggccatcaggccgatgggaccgaggccgataacaaggacatggtcattcaggcggatatcggcggtcttgacgaggtcgacagccacgccgagtggttcgagcagggtgccgtcgacaaagctgatcgccgggtcaagcggaacgatgcactgttcgggcagcaccatatactccgaaaaaccgttgatttttagctgcgcgttgttataaccctttgtgcacaggtcaacgcgcccatttcggcattgttcacagacgccgcaaaatgatccgctctcaacggcgacccgctgcccgggccacacatggcgcacgcccgggccggtctgttcgatgacgccggtcatttcatgaccaaacgtcacccaatccgccgcctgtgaacgcgcgatgtgcagatcggaaccgcagatgccgcacgctttgaccctgagcaggacctccccagcagcaggctgcgggatggggatttccttgattttaaactgaaaaggtgctttgacaaaaacggttttcatcatacgttttgatcagtcctttttaaactggtcgatcacaactgcgatcaggatgattacgccgagcgtgatggtctgccagtaggaggaaacgccgagcaggctcagagcgttgttgatgacgccgatggcgacaaggccgaatatggtctgaatgatgccgccgcgtccgcccgacatgcttgtgccgcccatggcgaccgccgcgatggcgttgagctcatagctctgcgcggcgtttggctggccgctttgcagcttggaggaaagcacgacgccgccaagcgccgcaaggatgccgcagatgatatagacaaggtatttgatcttcttgacattgataccactgagcttcgcaacttccgcgttgctgccgaccgcgtagatatagcggccaaaacaggtgcgagacaggatgatgtaagccgcggccagcacgatgatcatgacaatgacagtaacgggaatcgggccgatgctgcgcaggccgacccagccatatgaatcgggaaggtcaaagaccggcttggaatctgtatagacaaaggcaagtccgcgtgcgatgttcatcattgcgagcgttgcgataaatggcgggacattgagctttgcgacggaaaacgcgttgatcgaaccacagataccgcccacgacgattgcggcaagcagaatcacaagcacgctcagcccgcgtcccgcgtccgggaacatcttgatggtagctgttgcgacaacaccggccaaagcggcaacggagccgaccgaaaggtcgattccgtcggacaggataacgaatgtcataccggtggcgatcagggcgttgatggcgatctggatcaaaacgttcatcaggttgccgggtgtggcgaaccggtcgacaaacagcatacatgcgatgaccagcacaatgacgaacaggagcatggtatattccttcgcgaacttgcgcaggccgcttgctgtgacattttcttttgtattggaaagtgactgactcattgattacacccctgtttccgtttcactgttgaagctggcgtactgcatgacttctttttcggtcgcgccctcggcgttcatgatttttgtgacaacgccgccgcgcatcaccatgatgcggttggagactccgagcacctccggcagctctgaggaaaccatgataatgctgccgccgttttcaacaaactccttcatcaaggcgtaaatctccgccttggcgttgacgtcgatgccgcgcgtcggttcgtccataatcaggatacgcaccttggcggccagccacttggcgataaccaccttctgctggttgccgccggagaggttgcgcgccagcgcccggtcggacggcgtcttggtgtgcagcttttcaatgtattccgccgcaatggtgttttcccatttgaaattgataaagccatggtgtgaatttgccatcaggctggcaagcgacgtgttctgccgcaggttcttttccagcagaagcccctggccgcggcggtcctccgggatcagcccgatgccggccttgatggcctggcccggcgttttaaacgcagccttttggccaaacacctcgatctcgccgcttgtaaaacggtccgcgccgaagatggcgcgcatcacctcggtgcgcccggcgccgatcaggccggaaacgccgagcacctcgccctgatgcagatcgaatgaaacattttggaaaacgcccttgcgcgtaaggtttttgactgaaagcactaccgggctgtccttgggcgcttcggccttgtaataatactgcgtgacctggcggccgaccatcagggcgatcatcgtttgttcgtccgtttcagacagcggcattgttttgaccacctggccgtcgcgcagaatggtgatattgtcgccgatttcaaagatttccttcatgcggtgggagatataaatgacagcgacattttcgcttttgagcttattgatgacgcggaacagcgcctcaacctcatgatctgaaagcgaggaggtcggctcgtccatgatgaccatggagctgttctggctgacagcgcgcgcgatttcaaccatttgcttgtctccatttgtcagcgtccggatcaccgcgcgcggattgatcttgacgccgatggaatcaagcagcttttttgtttcagcgaacatggtcgctctatcgatcaaacctgtcctggcaattttcggttccctgccaagaaagatattttctgctacagttaaatcggggataacgctcagttcctggtggatgacgctgacgccgtgagccagcgcctgccgggtatttgtaaacgtatattcctgaccgccgacaagcagtttgccggcatcagcctggtaaacaccggaaataattttgatgattgtggattttcccgccccgttttcaccgaggaggacatgcacttttccgggataaaacgcaatggaaacgtcagacagcgccttgacgccggggaaggacttgctgatatccacaagctccacaaaagggttcgtgttcactgtttcactcctctgccaaagttttggggcgtcgtttgccggcagccccgtgtcgcctgaaaccgccggaaggccggcggggaaggggacccttccccgccgccggcatgtggaaaatgaaaggaataattattcagcgttggaagcgtcgatgatgtacggggcaatcgggatgttggattcaacctgggcgccgccgaggtaatcgacaactgtctgaagggtggtttcaccgatcgcagtcggatcctgcgcgacgtcagcaacccacagaccaccggatttgatcgcgtcgataccctcgggattgccgtcaaagccgataaccttgcactggctgttggcggaagtgatggaggccatcgcaccggtagcggccgggtcgccgacacagaagacagcggccaggtcaggggtcttaagcagcatgttggccatcacatcggcggccttggactggtcgccggagtagttctgaatgtcggcgacaacaacgtcgggagcattggccgcaatccagtcggtgaagcccttttcacgctgcacgcagctttcgatctcggaataggtgatgacgccgacattgcccttcttgtcggtcagcatgttgttgaccatgtactcggcagccagctcgccgcccttgtagttgtcggtcgcgatgtgcgcgacggtttcaccgtcggaagcgatatccatcgtgaaaaccgggatattcgcggcggtggcaagctccaccatcgacttgctgcctgcggagttggtcgggcagataacgatggcgtcaacggcctgggtgatgaagtcctgaacctgactgagctgcttgttcgcgtcgccggaagcatcctgaacgatcagctcgacattcagctccggagccttggcgaccatggcagcctcaatgttgttgtagaaaacatgctgcttgttgagcaggctgacgccgacgcggatcgtttcgccggaagcggcgggtgtggaagcgccggttgaggctgcggaagaagccggggcagccgcgtcggaagaagcgggagcggccggctcactggccgccggagcggatgatgtggttgtgctgcttccgccgcaggctgcgagcgaaatgcacatggcagccgcgagggctgcgccgagaatgcgtttgaacatagttctttcctcctaatgactctgtttcagagttttctcaagcctgcctgaaaaaccgggaatcaccgggccgcccgcaagcggttatggccgcttgcggggcggatgcgtttccagccttccacacatgcttattttaatcaaacggcttttgccgtcgattacgctttaccctggctgccgcagacggtgatcttgtgtttgacaagctccaccacggcggcgcggccagcttttccgtagacctttgggtcaaagaccgaggcgtcgtttgcaagcaccggccggacagccttcgtataggcgtcacgcagctcggttgcaaaattgaccttacaaatgcccaagccgattgttttctgcaccgcctcgtccggaacgcccgacgcgccgtgcagcaccagcgggacggaaacaactttgcgtatttcagcgaggcggtcaaaatcgagccgcggctcgcccttgtaaaagccgtgcgccgtaccgatggcgactgccagcgaaccgacgcctgtgcgctcgacaaattcgcacgccttttccgggtttgtgtacatcgcgtcggcgtcgagcacgacatggtcgtcctccttgccgccgaccgtgccaagctcggcttcggtcgggatgccgcgctccttggccatcgcggctgtcttggcggaaacagcgatgttttcctcaaaggagagcttcgagccgtcgatcataacggacgtatagcccgcgcaggcggcctgctcgcacagctcatagctgctgccatggtcaagatgcatcgcgaccggaaccggggcggattcggccagcgccgcgacaatcgcccggtacacggacaggcttgcatacttaaccgtggacgaggtggtctgaatgatgaccggggcgtttaactccgtcgcagcctggataacggcctgcgccatctccagattctccacgttgaaagcgccgacagcataatgcccgtcctgggctttctttaagaattcagttgttgtaacaagcggcataatgattcccttctttaaaaacagttgtgtatagtcgatatggttttcagatctctctgacggagatcagttccatcatctgtttaaaatcctcaggcatacacatttgcgtaccgtcgtggatcagcgatccgtgcgcgaccgctacgccataatgcagaatctcaggctcgctcacgccgtccagaatcgccatgcagatgccggagacgagcgagtcgcccgcgccctgcacaccgcgcaccggcacgtcggcgccttcggaaaaccacgcccggtcaccgctgacaagcagcgcgccctccttgcccatggaaatgcagacgtatttgacgccgttttccgcgatgattttgcgcgcgacggcgatggaatcatcgagcgaatggattttgcagccgaaggaagcttcaagctcgtcgcggttgggcttgatcagaaacggcgcagccttaatgccctcggtcagaagcgggccgtaagcgtcaagaatggcttttttgccgtacgcgtttgttttttcaatcatacgcttataaagatccgacggtacacccggaggcgcgctgccgttgatgaccataatatcggaacgctctatgtacgcgtccattctgttcatcaaagattcaacgtcctcggccgaaacaggcccgccgccttcgttaaactcggtcatgacatgcttatcggcgtcgaacgccttgatgttgatgcgcagcttgccgggcacgtcgaccagatcgtatgcgatgcccattctggaaagatcgcgcgtcagcgtgtcgtcgccgctgtaattgaagccgacacagagcgtttcacgcccgagctggtgcagcgcgatgctgacattgatacccttgccggagatatcgctgcgcacgtttgtgatcttgtttgtgccgccgtatcgaaagccattgatcgtgattgtccggtcaacgcacggattcagtgttaaggtcgttaccatgcttaccctccgattaacccttgagatgatcctgcgcccaatccgccatcgactggtaaatcagccagacggaggtcgcaccggcgtcctgcaagccaatcgcggcctcgccgtaggattttgcgcgtccaaaccgcgcgacgcactgctttgtatactccataccgcctttggcggcggccgccgcgtcagccaggccgtcctttaaatccttaccggcgtccgccgcctgctccaaggccacaacagccggttcaaatgcgtcgaccatcgttttgtcgccgatcttcgccttgccgcgccgcttgagcgcgtcgagcgaggcgcggaaaatctcggcgaagccgcgaaggtcgattgtgggcgacggcgcgcgcttgacaatgccgctgataaacatggtgccgaacagcacgccggacgcgccgcccatcgtatcaagcaggatattgccgacctcgcaaaaggcgtcctcggcgttttcaagctttgcgccgggcaggtccttaagcacatttttaaagccggttgccatcccgatgccgtggtcgccgtcgccgatcttgatgtcgatttcagtaaggaaatcttcgctgtcaaccagcctgtgcgcgacgaacaggaacatgtcgcgcaattgctgagcattcattgtaagcattgcagtcagcctccgatcgcttcttttttgaaaaacggcgagtaagcgggcatatcataatactttttcagctcgtcatccagccgcatgatcgagatggaaaggccgccggtaccctgtggacggaacagctcgtcgatgaagatgtcgtgcacgcgcgcatttttctccgcgagcagcgaacggacgcgccgccccagaatacacagctccagagggcttgtgaagccaaacccgttgatcatgacggcgatttcgtcccgttcggtcagcttcatgtcgtcgcagagatatttcatcatcgtctcagtgatctcgtcggcgctggtcagctttgtatgcagcacgcccggttcgccgttgaagcccatgccgtactcgatttcaccctccggcatttcaaacatggcgcgcccgctgcccggcatgtagcccggcgacgtggtgacgctgaaggtgtacgtttcctgcttggcctttgtcgcgatgcgcacgacctcgtcgagcggaagtcccgcgtcgcacgccgcgccggccaccttgatcacaagcgcgatgcccgccacgccgcggcgttcatctttgcgctcgatcggctccgaggtgatatcgtcggtgacaaagacgcatttagcggtgatgccctcaagctcggccagctcgctgacaagctcaaagttaagcacgtcgcccgcgtggtttgtgcagatatagacgacgccccggtcgtgcgggacggcctttgtaacgttgaggatcgtgcgcgagggcggcgcggtgtaaacgttgcccagcgaagcgcccgtagcaagcccgcggcctacatagcccatgatccacggctcgttgccggcgcctccgccaacgacgatggaaaccttgtcgccgtggtcatgtaccataagcccgtttgtgttgggggcgtcgaccttgtcgaacagccccggatagatggagaggtaaccctccagcatctccttgatcatattgtcaggatgattgataatcttgttcaaaccgccttctccttttcccgcgccttggattcgtcctgcgcgatcacaagatgaacgttggcgtccagaatttcctttgcaagcgcccgcgggatacgccagtccgtgataatcgacgaaaaccggtcgagcgggcagatgcgcgccattgtaaccttgccgaatttggtggcgtcgcagacgaggatcgcctgacgcgaaacctcaatgaccttgcgtttgatctgcgcctcggtaagattgggcgttgtgacgcccatttccagacacaggctgttcgtacccatgaacaccttgtcgaaacacatgccttcgacagcccgctcggccagcggaccgacgcatgacataatcttgtgccggacgtttccgccgataaacacgagattgatatcgtaggaatcgatcaattccgtaacaatattgagcgcattcgtaacgacaacaatatttcgcttgtttccgtttctgatcagcttgacgatttcaagcgtcgtggagccggcgtcaagatagatggtgtcggcgtcgtcgatcagatcgtaagccagccgcgcaatcgcctttttttcacggatattctgccgttccttttcgcgctcgccgctttcgcgcagggcgacggaaaggctcacagcgccgccgcgtgtccgccgcaggcagccctgcttatccaggtcgttgagcatcttgcgcacggtgacttccgaaaccgcgagcttgccgctcagctccgttacagagacggaggattgctcgtcgagcattttgagtatcatgtttttgcgttccacagtcatcattttcagcaacgcctttcgatttcggtttcattgtatatttgaaagcttcgattttcaagagattttttacaaaaaggatacagtcgatgacaattttatagcattgtccaaattaaatacattaaatttagttataatgcctatatatttggaaataattgtttcaaaaagtttcgaaatgggatacgcctggaaaggaaacgcgcacaatgttgggtatggattttgaaagcttttgcagggctgtccctccggcacgattttgtgctatactataaacagatgccgccggccggagcgggcggcggcgagctttcactttggagggatccatatgcgacatttggagctgtttttcgactatgcctgcccgtattgcctgcgggcgcatgaactgcttttggagctgctgccgctgcattcagatattgaaattgactggcggccgtgtgaatcgcacccgcgccccgattcctacggcccgcacagcgacctttgcatccgcgggatgtatttcgcgcgcgagcatggcgccgatcttttaaaatatcaccggctgatgtaccgcgcagctctgattgaacgcgcggatatcgaggatcccgctgttgtcgcccgtgcggcggccccgctgcttgatgccggcgcgctggaacaggcactgcgcggcggacggtacgagcgtgaattgcagaaagcgaacgcctatgcctttgaccgttcgggcgtctgggcggtgccggcctatcggatggacgggcgcagactcgacgcgcgcgaaaatatcggcgtgacgcgcggcgagctggcggcttttctggcgggatgagcgcggcggacaaaaagcggctggccgtcgggattctcgcgcatgtcgatgcgggcaaaacaacgctgtcggaggcgctgctttaccgaagcggtgcgctgcggacgcttggccgggtggaccatggggatgcatacctcgacaccgatgcgatcgagcgggagcgcggcatcacaatcttttcaaagcaggcggtcctgacgcttgacgggacagagctgacgctgctcgacacaccgggccatgtcgatttttccagcgaaatggagcgcacgctttccgtgctcgattacgcggtgcttgtgatcagcgggacggacggtgtgcagggccatacgctgaccctctggcgccttttggagcgcagccgtgtgcccgtgttcctgtttatcaataaaatggatcttcccggggcggaccgcgcggcgctgctcgacgagctgcgccgccgtctggacggcggatgcgtcgatttcggcgcgccgcacgaaacgctttgcgaggaggcggccatgtgcgacgaatccgtgctggagcagtatcttgaaagcggggtaatttcggacgggacgcttgccgggctgatcggcaagcggcggctgttcccgtgctttttcgggtcggcgctcaggctcggcggtgtggatgaactgctttcggcgctcggccgctatacgcgcgcgccggattatccgcaggcgttcggcgcgcgtattttcaaggtgtcgcgcgatcaaagcggcgcgcgtctgacgcacctgaaggtgacgggcggcgtcctgcgcgtcaaggcgcttatgacgaaccgccgcagcgggatgccggatgaacagatttgggaggacaaggccgatcaaatccgcatttattccggcgcaaaatacaagacggccgatgaggttttgcccgggaccgtctgcgccgtgacaggtcttgggaaaagccgcccgggcgaagggcttggatgggaggcggcggcgcagccgccgctgatcgagccggtgtttgcataccgcgtgcttctgcccgacggctgcgacgcgcacgctgcgctgctcaagctgcgcatgctcgaggaggaggacccgcagcttcacattgcctggaacgggcgccttcgggaaatctgcatccagttgatgggcgaggtgcagatggagatcttaaagcgccggattctggaacgctttgggcttgacgtgtcctttggaaaaggcggtatcgtttaccgcgagacaatcaaacagccggtgcgcggcgcggggcactttgagccgctgcgccattacgcggaggtccatctgctgctggagccggccggacgcggcgcggggatcacatatgccagcgcgtgcagcgaggatatgctcgaccgcagttggcagcggctgatcctttcgcagcttgcacagcagacgatccccggcgtgctgacgggcgcgcccattacggacatgcgtatcacactgctggccggacgcgcccatgaaaagcacaccgaagggggcgatttccgccaggccgccctgcgcgcggtgcgtcagggtttgatgcaggcggaaaacgtgctgctcgagccgtggtacagctttcgcctggagatccccggcacatgcgtcggccgggcgatgtctgatttgcagcgcatgtacgcacgcgtatcggctccggaaacggcggccggcggtgcggtgctgaccgggacggcgcccgccgcgtgtatgcgcggttatgccgccgaggtcagcgcctatacaaaggggcgcgggcggctgttctgcacgctgagcggctatgagccgtgccacaaccaggacgaggctgcggctgcggccgggtacgattgtgagcacgacctcgattttccggctgattccgtattctgcgcgcgcggcgcgggatatacggtcaaatggagcgaggcggccgcgcatatgcacgtggatcccggccgtctgccgggcgtacaagtccacgaaacggacgttcccgcggcgcgcggcgcatcgcgggaaccttattccggcacgctggagcaggaccgggagcttgaggcgatctttgagcgcacctacggcccgatccggcgcggtccggccgggccggcgcgcgttgcgcggcggccggaggttgtgccgccgtgggacggcggggccggtgcggggccggaatacctgctggtggacggatataacatgatctttgcatgggaggatttcaagcggctggcgcgcgatcatctggacgcggcccgccaggcattgatggacctgctctgcaattatcagggcgttcgcaaatgcgcggtgattctggtgttcgacgcctacaaggtgccgcgcggcacaggtgcggtcagccggtatcacaacatccacgtcgtctacacaaaggaggcggagacggccgacgcctttatcgagaaggtgacgtatgagatcggcgggcgccgccgcgtgcgggtggcgacgtcggacagcgcggagcagttgatcatcctcggccacggcgcgctgcgcgtgccggccgacctgttccgaatggagcttgagcgcgccagcggagaaattaccgcttttctggagaaaaacaaccgcctgaaaaagtccctgaacgtcagggcggctctggaacgggcgggcgggagcgccaaagcgccaaaacgggcggccggttcgcccgggaaataaaaagcggggccgccggaaaacttccggcggccccgcttttatgaatgccttcaggcgtttcggtcctgctcgatcagcgtgcgcagcgcctcgcaggcgacctcgacggttttgcgcatgtcggtatacgccatgatggacgacgcgcggcagccgcggatgatcgttggcaatcgccaagatgtcccggctaacacaaccgccgtaaatcgaaattgacagcttatttctatggacggaaccggtagatttcttagtagctgcctgcatgatgcgcctgctctgagctctgaggttccggcggggcgctcacaatggggtgaaagactgcgagctgatccatcaaagaggtgaccttgttataccagtaggagacatccgttgtacgccctttgatcttttgaaaatgtgcatacagaggaacgcccactttgtcgcgtaattccgggcaggcgttcatcagaacacggaagttctttaaaaggccggaatacagcagttgttgaatgggcatatcctgcgcttgagaggaattgagatatgttatgcctctcttacggcggatttctgcttcatcccatgcggcctgttccgcttcacgctcgggaagcagacgcatatcccgccagtacggactgtctatggcaagttccgggcgcagcttttcccggtcggcgttatccatttcataatcaaatgggatggccgcgactgccggattgagttgatagagcatgtccagctgtagacggatactttgatgcactgcataggacatcttcagcagacgcatcattttgatcgactggagcggttttaattgggtttgatgcgttacatggtcgccgacaccaaaatgatatccgtgccggaaggtataatactggttctccagcatctgaatgggccggttcccaggaaggtgagagagttcatattccacatattccaaaaacgcgggctgaagcacatctgcaccaattacaaaatttgcggcgtaatcgtcatagatgtcctgtacaaaccgcatacagtcggtttgttttgccacgtgagtattcagatattttctgcccaaataaggacgggctacaatttctccacaagccccaataagcttacactgctcaggctccaaagacttcaaaatccctaagctatgtgtatagtacgtaccgaggcaggtatttctccatcggatatctccttcctgatatgacaatctctcaaacgcttggggaaaatcgtgatatgaatagtgataaaggctattgatccgggtcgcaatctccagatcccggctgcccccaaccgggtgtgtattgattttaacgcgttctctatcaaaggaaaggttggtaagggcactgtagatcagacggctgtccagaccgcccgtcaggtccactataaccttcttaaagcgcagctcttttaaaatatcagaaagaatctcaatcaggtcgtcttttgcctccaccagctgcttgcgatagtcctcctcgtgataaacgatgtcttctttcatcagcctgccgcagccgctgtctgatatattccacccgctcgcatctagcgtaagctgtttgtccgcggtgagctgatagacatctttcaggtccatggagcgggagaaattctgcgaaagaaactggagccttacgctggaaagcgtaacacaggctttatcaacgtccaagtccaagtggatatttcgctcttttagggccaaaagcagcggatagtaactgtttgacatgataagaagcgtttcactctgataataaaaccaatgattaaagccaaagaaatctactccggccaccagatttttgctgttccatgctacataggagtaatggccctgatgatcggcaagcgcctgaccgctctctagggcctgctccacctccgcgccaaggtatatcttgcggttacggtatagccgtccagaaaagatcgctttgtccctgttagcacaagtcaatagctgtccctgggaatagaacgcggtgttccagtccccgattttattctcagccagaaatgggacggggaatgctccgctgaacgcctccggacgcctgcccttttcggagatcaggacaatattacaaaaaggtgtgttttccggcacgaacggcagggtctgagatagagtaatacccttccccactgtttcgtcttccaggaaggtctcaaactgagccttggccgtttgtccaaaccaggcggtacacaaggtgcgccggataaaagtttttccgcctcgtttgataaagccctggacgctgtatacgccgtccttggacaactcccattcggcgaatggattttcgcccagaggggtcctttgatcgatctgcccgtccagacacaggtaaaacgcaaagcggtctccgggcctcagatcaggacattcaaaatgggcggacagccggttgcctgtatactctacggcgatgcgggcgtcatccagccccctgaattgctgcctctgaaccacttcttgcaggagttctttgagtttatctttatgctcccggtacaattccgaaacaaaagcggcttgttctccggtatacgtctgacttgtgatgatggaagggagaagctcgacgttgctcgaggatggatctctacatatgtgataaagctcctccaggatccagagcaaatgcctggcatccaatccgctctcccacaaactccatcggatcacatagactggctcatcttttcctgcactcagaacccgcgcccattccttgcgcagctcagataccgccacctcgtccgggatgtccgttgcaaatacccgctcctcccactcgcttgccaggtcaatgggatccaacaacatgaagtcacccttttttcgcgcatcaaccggggtgatcgcggcggaagcacagtattcctttagctgttcagggccggacacatgggccattgtgggaaaataagccaaggtgctgctggtatgatactgaatatcttcgttcttcttggtaaaatatacaactgtataccatccaggtttttgcagatcccatgttataaaaggggtatctgcatacgcctgtgtatgaactcgttcgccgttgcactggacatagaaagcgtaaagagcgccctcatcgggggggatatccatgataaaagagagacgattgtcttgaatggtaaaagaatacttaatttcttccgctttatttgtcatttagttttctcctgattctatgatactcatatttatgggtgcgggaggaccacacacagtttccagaatttcggaattgtattcccacgtgggaataacggtaaaaggccgccatggcggccttttaatccttctattagggacaagaagggcgcttggatatcaaaaatcagcagagcagcttgactgcggagcttgtaccaatgcggtcgcagcccgcgtttacaaaggcttcaagatcctcgggcgtgcgaatgccgccggcagccttgattttgaccttcgggcctatgtgtttgcggaataaagcgatgtcctcaagctgcgctcccgcagtgccgaagccggtcgaggttttgatgtaatcggcgcccgcctccgtaacgcagcggcacagggcgattttctcctcctcggtgagatagcaggtttcaatgatgaccttcaggatgcggctgcccgcagcctgtttgaccgcgcggatttcttctgtgaccttgtcgaacgcgccgcttttaacgtcgcccagattgacgaccatgtccacttcaacagcgccgtcagcgatggcctggcgcgtctccgcaaccttgatttcggttgtgttgtacccgagcgggaatccgataaccgtacaaatggcaagcgcatcgccgtattgatcatgaatgcgcttgataaagcacggaggcacgcagacagaagcggtgtggtatttgaccgcctcatcgcagagcgactcgatttcgggccaggttgagacggctttgagcagagtgtggtcgatcattcccaaaactttttctttgtccataaaaccctccgttaatctgacagtgaatcgattttgtgataaaataaatgcaatgcatttattctatcttttatggccagggcgatacgcgggcgcggcccgctgccgccctgatggccgattttatcatgctgctttgtgagcatgataaaatactaacatttcacaaatgttgtgtcaatctattacgaggtaatttctctagtttagacataattaatattttggatttattaattatgcgcatatactgttgcacaaacaaaattaaaaaatactttttatcaaaaatatcttttgctttttgataaaaagtgttaatatgtgattggaattttgataacagcaggatacagggtgtttgaatggaggctaatagcgtgggcaagaaaaacgatagactcaaccggctcattgggattttaaaaattcgcggcgcggtatcgatcagggagcttgcgcagacgctggaagtctcagaaatgacgatacgcagggatatgaagctgctccagcagaataaagtggtcgaaaatgtcgatggcgttatggtctacaatcccgcgcatacgcttgtcgaaacggacaaggagtacagccttgcgctggaggaggaacgcaggaatgcggaaaaagctgcgatcggtgcatttgcggcttcgctggtggcgcaggacgatatgatcatcattgacacggggacgacaacggtccacatcgcgcgcaatctgccaaccaatttgcatctgtcggtattgtgttataatatcaacattttgatggaattgagacgaaaaccgaatatacaaccgctttttgccggcggttattatcacgcaaatgcacagatgtttgaaagtaaggagggcgttgaattcatcagcggaatccgtgtgcaaaaggcgtttgtttcagcggcaggcgttcattgtcagttgggcgtaacctgcatcaacaattacgagatcgagacaaaacgggcgattttgcactcctcgctggaaaaaattcttgtagcggattcaagcaaatttggccgggtctgcgccgcttactgctgtgatatgaatgatattgatacgatcatcacaaataagggcctttcgcccgaatggatcgacctgattcgcagcaaagggatcaagctgtaccttgtttaattatgagtatgcgccgtggctgatacggcttttgatttaaaaaaagccccggatacagacgaaaaatttgtgtgaagaatctgtgttcctattggacagcgcatagggtttggagtataatagaagcaatcacacctatgggaggttttggcatggcggataagaagcagtttgacggatcggaaacgtcggaaaagtctaaaagcctgcttttctctctctcgcaggcaaagccggcgtccaccgccgaggcggagacatcggctaatcaaagcttgctgtacacgctctggaaaagcgtctccggaaagtttgcgaagcctgcacagccgcaggaagaaaaaccggctgcccaggagccggaggcggagctgtttgaggatgatcatccgcttgcaaggctgcggcgcgcctggagccaggagcaggcggcatcccgtggggacaatacagattcggaccaggcgcccttcgggccgcgggatctgcttgatggcggggagctgctgccggttcaccgccggctgatcgagcaggctgcccggtcggctgcagagatgctcgcgtcgtttcatggcgatggtgaacagctccaggcggtcaatgggcatgtcggggtgatggaatccgaggatggcctgagcgcctggctgctgttgctgccgccgctgtatgggggcggcgatgtgacgctggagcatttgtataccgcgctggtcgagcgcggtattacatatggcgtcgacatacaggcgcttgagacattggcgcagcctctttatttccgtattgtcgaggctgcgcgggggacgccgccggttgacggtgaggatggaagcgtcgaggaggtcatcccgaccagttccagcgtccggtttgtggaaaagcaaaacggcatcatcgactttaaagatatgaactggttccacaatgtcaatgcgggagacgttctttgccggctgatcccgcctgtgccggcaaagaacgggaccaacatccatggcgcccagcttaccgccagggaagggcgcagggctgtgccgcctgcggggaaaaacacggttgtcagcgaggacggccttacgctcgtcgccaggattgagggcgaggttgtttaccggtcgggccaataccatgtggagcaggcgcttacaatcaatggaaatgtcgatttttccacaggcaacctcgatgtaaagggcgcggtgatcgtgatgggcgatatctgcgaaggctttacagtcaaggccagcggcgatatcactgtatatgggatgatcgaaggcgcgacgctggtttcgggcgggaacatctttgcaaaaaccggcatgaatggaaatggaaagggttcaatgacagccaggggggagatccgctgtaaatttattgaaaacggttctgctgatgcagagggaaatatttatttggagagcgcgatcaatgcgcggttgtcaagtcaaagctccgttttggtcaaatcaggccgcggcgcactgatcggcggggaaactgtcgcgatgaaaacgatcgaggccacgtcggccggcaataaaaacaattacctgacaaccgtttccatcaaagcgaccgaatcgttcaaaataaagcaaaagcaggtcgaggacgaccttcggaaaacgtttgaggagctggatgagctgacctcgtcagaaaacggcacggctatgacgaatgaagcgcgcctgcgcagcagcacgttgaaaatgaaggaacgaaagcttcgccaacagctcgagcagatgcgcgcgcaatgtgaggagctggattcagccgtcatgcgcttcggcgcactgtatccaaacacggtggctggaatcggcggcgcggccgcaacctccaagcaggagcatactcactgcctgatttatcaaaaggatcgtgaaattgtgtttggcacggtataattgatattttaattttcaaacaggccccagggaacaacatgattttaggtgaagcaaagtggatgatttggatatcggcagcgtgctgcaggccagccgcggtgaaaaaaagatcagcctgcgccagttggcggaaaggactggtctgacagcttcgatgttaagccagattgaacggaatcttgtcaacccttccatcaatacgctcaaggtgatcgcagcggctctcgagattcccatgtataaattttttatgggcggcggcgctgacaaaaatctggtcgtacggcgtgacgcgcgcattacgctcggacgtcctgaggcggaggatatcgtatatgagttgctgaccgcgaatgtcagcggcagtatcgaattctgcatgatgcacataccggccaagaacggttcccacaatgtggagtccatccacaagggcgaggaagtcgcatatgtggcgcaggggaagattacagtctatatcaacggcgccgcatatgaactggagacgggcgacagcgtgctgattccgccgggcagcgtccaccgctggcagaacagcgcggatgaggaggcgcaggtgctgtttgccgtcacaccgccgagtttttaactgtgttcagttaaatttaacaaatttcgaggctttctgttcagcattcatacagatttctctctgtatagccaattttttaatggaatctgttgacttccaataaaatgatgttaaactgtacttaacgatacggctttattgtcgtgtacagtttaacatctttctttttttctaaggaaaataacggtattgggaggtcgtttttatgggaaaagatttatcggcggcgtatgcgtacattgatgaaatccgggatgaaaccattgcgctttacaaagaatttgtaaaccgtgagagctggagcaaaacgccggacaaggtccgtattttttccgattttctcaagggggagatggagaaggccggctttgaatgccgctatgtgcctgtcggcgtcaacgccgatacgcttgtcggcattctcggcaaggaccgtcctggtaaaccgattctgttctgcggacatatggacacggtgttcccgacagggatgcatccggaaaacccgtttaagattgaggacggaaaagcgtatggaccgggtgtgctcgatatgaagggcggcattctgattgcgctgacgacagtcaaggcgctgaacaaaatcggatatgcggacaggccgatcaagttctgcttttcaggcgatgaggagatcaatcacaccggctcgcagggcgctgaggtgatcgaggccgaggccaaaggctgcctgtgcgccttcaatatggaaaccggcatgatcgacaactacctgtgcaccgggcgcaagggctgcctgcgttacacggtggaggtcgacggtgtggagacgcactccggcaacgacttccagggcggcagaagcgccattgccgagatggcctataaaatcattgattttcacaatatgaccgatctttcaatcggaaatacctgcaacatcggcactataaccggcggaacggtacccaacgcggtgcccgctcactgtgaagtggttctcgatatgcgctataccactctgagcggcaaggagaaattgctcgcgcagcttgatgaaatctgcaagcgcacgcacatcgacggaaccaccacaaaatatgcgtttttaaacaagctcgatgtgtttgagacaaccgacgaagggatgcgctttttcaattttgtaaaggacatcgcaaaggaatacggcctgcctgaggtcagcgggcgtccgcttggcggcggttccgacgcggcctccacaaccatggccggtgtcccgaccatctgctcctgcggcgtgcgcggtcagtggaaccataccatgaaggaatatgcggttgtcgattcgattttcgacaggagcaaaatgtatgtcgccgccgttgcaaatgcagaccggtttgcagagggtgcggactgagacggcgaaacgatcataaaaattcctgcttaggagggagagatagcaatgaataccctggttgtgtttctgatttccatgatctttctgttgacagttctgatcaaattcaaatggagcgcgtcggtggggcttgtgttggcgaccattctgatgggcctgctttcaggcatgcaggtgggcgagctgaccggctttatcagcggcgggtttggcaataccatgacaagcacgggccttgtcatcatcttcggctgcatcttcggcgagatgctcggttcctccggcgcgctggaggaaatcgcgaaattcctgctgcgcaaggttggctccaagcatgattacctcgcgatcaatctgctgggctacgtggtgtccatccccgtttatttcgggtcggcctacgtcatgctttcgccgcttctgaattcccttcagaagcttaccaacaaaaaaatgattgggtatgtcaacgcgctgtttgtcggcttgctgctgacgcattgtgttgtagcgcccacgccgggtccggtcgctgtcgcggcggaggttggcgcaaatctgggctggtttatcttctacggtatgattgtctccattattgccagcctgatctgcggctggcagttctccaacgcactcaacgcgcatgaccggaaagctgtgcgggagatgatatcctcggacaacgagctgattcaggctgacccgacgaagccgtctgcggcgacagggttccttctcatcctgtttccgatcgttctgatcgtgctcggctctgtcattccgatgtttgttgcagaaggttccgtcatctatacgattttccagttcgtcggcgataagaacatcgcgctgttcatggcgatgctgctttcggcaatcgtgctcagaaaatatcttgttgcgggaccggcgagcaaggggatcatgcgctacatcgattccagcgccaacaaggtcggcagtatcctcatggtcatcggatgcggcggctgttttgccaaggttatcacggaaacgggtatcggcgacgcgctggcggagatgttctcacactttaatatgccggtgattttgcttggttttattcttgctatgattatccgcgcggcggttggttccgcgaccgtcgccatgatgacggccgtatcgattgttggcccggccatcgcaattcaggggctttccccggtgcttgtgggtcttgcggtctgcgcgggtacggtcggcctgacccttccgacggacggcgcgttctggcatccgtcccagctcaatgggatttccatcaatgagacgatgacagtcaccatcagcacgactctggccagcttggcggcgtttgcaatcattctgctgctcaattgcttcagcggcgttctgcccggattattttagaaattaggagccaatccatggaaaacatgatactgacaatgacggaggatgagtgggtaaaaaaatacccgctcatccgttctctccagaatttgcaggaatgcttctggatcaacgacaaaaaggaaccgtttgacagcgcggtcaaaaaatgcgcgcttggaatgcatgatatcgaggatgccagcagccggctgacgcggtttgcgccgtacattgcaaaggcgtttgcacagacggccgccagcggcgggattttggagtcgccgctgcgtgaaataccgcatatgaagcgcgcactggaggagcgcagcggcgtcgccattggcggccgaatgctgctgaaatgcgacagcgagctgccgatctcaggctccattaaagcgcgcggcggcatctatgaggttttaaagcacgcggaggatctcgcggtccagcacgggctgctgtcctatacggatgattatgcctgtttggcgaagccgcgttttcgggactttttttcgcagtataaaatcgcggtcggttcaacgggcaacctgggcctttccatcgggataatgagcgccaagcttgggtttcatgtgacagtccatatgtcggccgacgcgcgccagtggaaaaaggatatgctgcgcggccttggcgtccatgtcatcgaatatgaaaacgactacagcaaggcggttgccgagggccgcagccaggccgaggccgatccgtactgttattttatcgatgatgagaattccaaggacctgtttttgggctatacggtggctgccctgcgtctgaaaaaacagatggaacagatgcggatcgctgttgaccgcgcgcatccgctgtttgtttatctcccgtgcggcgtgggcggcgggcctggcggcgttgcattcggcatcaagagcgtctttggggatgcggcgcattgctttttcgccgagccgacgcattccccctgtatgctgcttggaatgtatacgggatattatgaccgcgtcagcgttcaggatttcggcatcgacaaccgcaccgcggccgatggtctggcggtcggccggtgctcgcatctggtcggcccgatgatgcatccgttcatgagcggcgcgatgagcgtcagcgacgagcgcatgtaccggctgctggcgatgatggccgacacggaacaaatccgcctggaaccgagcgcgctggccggcgtgccgggcgccgtcaatttgtttggaacgaatgcgggaatggattatctaaagcgcgaggggctttccgcgtccgttgaccaatttacgcacatcgtatgggcgacgggcggcagcatggtgcccgacgacgttatgcgcgcgtattatgaaaagggaaaggcgctgcaatcgctctgaccggcgctttgtaaaaaagcgggcggtgcgggctgtagatacagcccgcaccgcccgtctcacatttgcttttattgctccagaatcggcagcgtttgcgcgccgggcctggctcgtgcaaagcgatttgccaaacagcctgtcgccgtcggatgcggcagcgccgggacgtttcccatcaaattatagaaggcgaacaattgagaaacaagcttgaaggtctggcggccggcgaaacagtatcaggcgccttttgtaatgagatacagaagttgacagcgcgggcggcgtaccctatacttaaagagcagataggttttgacccaaatgaaaaggggagggcgccggcatggaaagaaccaaagacaaacggccgcgcggtatggaccgcttttggagaggcgccatctacgcggcgggcatgatttccctggcaattgggctgaccttgtataccaagacagggcttggcgtttccccggttgtttcggtttcattttccattacggaaatttggggaatcaattacgctctgtcaacctttggcgtctacatgctgtttttggcggttcaattgcttttgaagggaaaggcgcgccgcccgggtgatctgctgcaaatcccattcagcctggtattcggcttgctgcttgactggttcagtctggtgcaaatccgtttttacacgctgtggcaaaatctgctgctgcttttagcagcgatggcgtttacagcagtggggatgtccatgatggtcgacatgcgcctggtgttaagtccggcggacggcctggccgacacgattggaaaatgtacaggcaggggcgtcggctttggaaaaaatattgtggatctgtcctgcgtggttgttacctgtgccgtcagttatcttttcagcggcaggataacagcgattggacttggcacactgatcgcaatgatctgcgtgggcaggctggccgcgctgtttcaactgttgttttacgagccgctgctccggcgcgcgggtttgccgaaagcacaccgctgcggcgcctcagaacaattggcagaggaatccgcctgatcagaccggcggcggcaagggctgcgttcgggttggcgtatgcggcaagcagccggataccgccaatttgcaggatgaattggtgatagagccgaatttatacctatcatggatgaacgggagcatcttttttgatgctcccgttcatccgtgtgcggccgtgcatccaatccgacggatacggcgcttacttctgggcgtttgatataattttttttgccagatcataaatgctctgcttataaagaacgagactgatttccaggctgggatgggatttttcaaaaccgctgaccacatctgctacaatttgaagcgcctgggcgcgcggaatatgaaaatcgccggaaaacatcagtggaatcgcgacgcttttgcaatggtaagcggccgctttttgcagcgcagagcggtaacagtcggcgaacaacattctgtcgttatagcggccgctgtaccatccaacgcccgccacatgaataatatatttgcatgcgagtccgaacgacggcgttatgacggctttcccaatacggcagcggcctatttttttacaagcggccaaaagcttttcagtatccgccgctgcaaaaatggcgctgcaaataccgggacacggcctcagatcggagtttgccgcgttgacgatggcgtctgtgtccatccttgtgatatctccaagtaccaaacgcatacgatcactcctatcacataacaactccgccaatgagataacccgccgcgctgacagccgcagcaagcagcgcatagggcatctgcgacagcgcgtggtccatattctgcattttacagcagcttgaggtcaataccgtcgcatccgaatagaagcaggcatggctgccaagcacagcgccggatacgatcgctcccatggtcagcagcggatttgccccgattgaaaaggcgagcggcaggatgatgggcgtgacgatcgcggggattccccaaacgcttccggtgctgaaatttaaaagcgcgacaagcacaaaggtaatcatgggaaatacagcggcgttcacaaagggccggacggcattgattatgtagcctgcgattccgatatcgctcatcgcttcctgcattacgaaggcgaaatagatgattgcaatggtggggatcatattgcagaacccatgcatggccaggtcgcaaaaccgggtgagcgtcagttttttgcggggaacatagagcgcaaggcaggttaggattgcggcggcaacggcaagaaatagttcgcccgaccagatagccaaaacgatcaatacaccgaccggaagaatgaaatccagaatatttcccttgacctcaactgcgcgcgcatcctcatcttcctcctccaagtttaactcccggctttccggagaatagaccttccccgtcgttttaacgcggttgtacgcctttttcatacgtcccagcttgggcagaaagccaaagcaaaacaacggcacgattacaacggcggcgatggcatagaatgtgtagggaatgacatggtaaaaggtttcaattgcgtttccatagccaagctccgcgacgccgttctctgcaaaaaagagtccggagaaaaagatcgcccaggtggaaaaggggagcagcgcgcagaccggcgcgccggtggaatcgatcacataggaaagcgtctcacggggcaccttatgcgtatcggtcagctttttcatgcaggtgctcaaggtcatgatatttaaataatcgtccacaaaaatcaggattcccatgatccaggtgaccagaagcgtggtttttggtccgcggcacagccgtccaagccacttggaaaagccaagcgtcccgtgggacgcgcccaaaagcgcaatcaaactgccgaacagcgcacagaccatgaacacccattcatggtcgcggtcggtcgctaccttaaagaacgcctccatccacccggtggggaaattccatccgcagatgatgatgtaggcgacaaccgtgccgacgatcagaggttccaaagtccgtttggtcagcaatgccaatacaatcactacaataattggcagcagggtccaaaggccaaaatccattttagtccgcctcgatttctattatgtttttggggacatgattaaaaaccagcctatgcagaaattgaaaacaagcgcccgtacaaatcggttctgagcaagccctttgaaagacggcaccgtaaaaaccgcctgcaatcccaacgctgttatttcgctttctattacggactaatatagcagattctattttaaggtgccgttaaggtgcgttccctcctgttaaaaaagcattatgatctttggctgtgtatagaagctgtaccaatggaggaacgtacatgtcccggcgggaaattttccatccgggctgcgtcagaaaaacttgaaatccgccaggattcctacgcatttcttccctgccggacaaaaaatttcctcaccgctttatgcactttccccagtggtacagcttctaaatcaaaattggccgccccaattgatggggcggccgccgatataagaagcttattctacacgcagcatccggtatccgacgccgatatgcgtttgaatatactgcggggagtcaggctccttttccagttttttgcgcagcgtagccataaacacgcgcagagaggcaatatcgttatcccagcttcgattccagatttgctgggcaataaacgtgtgcgttaagaccttgccgacatttttagataacagacataaaagcttgtattcgctgggggtcagatgcagctcctgaccgtccatataggcgcagcccgcggcataatccaccttcagctttccgtttgtgaatacagaatccgcgttcgccataccgcctgcctgtatcgcagccaggcgccgctgcgtgacgcgcagcctggcaagcagctcctcaacggagaacggtttggtcaaatagtcgtcagcgcccgcgtccaaagcttctattttatcggtgtcctcgctgcgggcgctgatcacgataattggaagattggaccaggttcggaccttgcgtataacctcgatgccgtccatatcaggcagccccaagtccagcaggatgatttcgggattgtgtgaggacgcctccaaaatggcggattcgccgttggcggccgtcaaaaagcggtaatcgtgcgctttgagcgtggttgtgattaaattacggacgggtacgtcgtcctcaacaactaaaattaaaggtttattcatgcagttcaacctccccggatggtattgaaaatgtaaagattgtcccatgcggaatttggtccgcaacgctgatttctcctccatgcgcatttacaatcgatttgcacagcgccagtcccagccccatgctgcggcggctgtccgcgattttggcggaggcgctgtaaaacatttcgaatatatgcggctttgcttcatctgaaataccgggtccgttgtcggcgatggaaacaaggacaaaatgcccctgctttttccactcgatacggatatcggaacccaccggcgtatattttatcgcgttatcgatgatattgatgattacctggacgataagcctcacatcgatttggaccagaatgtattcatccggttcgcggacgatcagatggtagtccgcgcttttgcggttgatatgacgcagcgcctctgcaattacttcatccataagttctgtggacaaatgcaagttcatacgcccttcttccagcctgctgacggacaaaagattttccaccagattgatcagccacatcgcgtcatcatatatgtccgtatacatttgttctttggtctgtgcgtcaaacagcttgccattggaaagaagattgcttgcattccccgatatggcggtgagcggcgtgcgcagatcgtgggagatggagcgcagcagattggcccgcagctgttcattttttgccaaaacagccgcggcttccttttcctgcgcgttcttctggttttccagcgccaaagcgcactcccccaaaacggagagcaaaatgccgttttcaaaagaatccaacggctttgcttttgccgctattccaatcacgccatatacccgatcgccgattcgtacagaccaatagacgcagagggaatcagaaaaggtttcagtcccagtaccggcgcgccggttatttttcataacccactgtgcgaccgcttgttcctttgcgctggtatacggtgtatcagagcagccctcatcggcggtgcaaaaaaggaccggttgtgacaaaacaccgttttcagcgcggtatacaacgatatccctttgaaaaagtctgaccagctgccgtgcggttatggccatgatttccgattgatccacagccttttgcaaactctgattcgtttcaaacaagagtttcgtgcgccaggcaacctgtgcggctctctgtgcgtgggacttcagctttgacgctaaggagccggtgatgagcgccgcgataaacatgaccagaaatgtgaccagatagccgctgtcatatgcgtgcagagaatatcgcggttccgtaaagaaaaagttgaaaataagaacgctggcggctgatgaaataaagctgcatacagggctttttgtggtcacagagatcagcatgacgctgaggatataaatggtaatgatattggcttcagtaaagccaagcttgaaaaacagaaagccgacaagggtcgccagaagcaacagcagcacgctttttacaagatcacacagggaaacggataaaagccgcatcggttccctgtaggcaggcgcagaacgcttgttgagtccattgtcgggaatgatatgaatatccagttctggagcaagctcgatcagccgttctgtcaacgaaggcgcgcggaaaatggttcggcgggatatcccgctgcgcccgatcatgatctttgtcacaccggataaacgtgcaaattccgcgatctgataggggatatcgtcgccatatacagtttcgacggacgcgcctaactgttcggccaaacggatattggaccgcagtctgtctttgtcggcctgaaagctccactggaactgttttgtttccacaaacaacgctgtaaagccgcatcgaaaggcgccggccatccgtgcggcggtacgtatgatcttggcgttagagggtgcagaggacagacagacgagaatgtgttcatgggtccggtatcctgcttgcttctgtgctttgcgagtttgcagcgcaatccggtccgcacagcggcgcagacctaattctcgaagggcgttcaactgtgtaatggataagggggaagataaagcaccgggctgcttcgctttcagacgatcgagcagatcctgcggctccagatccgcaaattcaacccggtcggcagcgtcaaacacactatcgggcacccgttcaggcagaccatgcccaatgatggctgagacggtgtcctgaaggctttcgatatgttgaatatccaatgtggtatagacatcgattcctgcctttaaaagctcctcgatatcctgatatcgttttttatgccggcagccgtccgggttctgatgagataaatcgtcgatcagaatcaattgcggcattctgtgcagcgcggcgtccaaatcaatttccatagatgcaggcgttccctgctgaatttgcttgcacggcaaagtctcaaaacgatctgccattaactgtgtttgcggccagccgttcgcggcgacaagtccgctgacaaccactgcccccgcctgcctggcgcgctcggcggcctcaagcatggcgtaggtttttcctgatcccggcgcataaccggcaaaaatggtcagggaaccttttggttcagaccgggtcattggagccattgaagttcccccctttaaacaaaagtagaaaggactggggccagagctttagacgtgacgcaagcgcatcatctatccaaaggaaccatcgccctggccatgaaaggcagaataatcgctctgcggttattataccatgtccgcgaagcggcatggtataatcgcccgtcaaaaggcggttgccgcgcaagcggcgagccgttgggcataaccctggtataataaccgctctgcggttattataccacagacttcaaaaattccttacacccacgcgccgaataaattccgggacaagcggagagggcgcttctttgctccaaaccagagcctgcttgtgcatcatctgatctataggctggagcaggacgccggattcttcaagacgcagagtccgcggctcaaacttgacgaatgcggtttccagacacaggccggtgcgtgtttcagcagaaacgacagccaaatcggcctttccacatgcaagataccgcaggatctcctgttgttggccaaaaacaattgtcacttccaaatttggataatccctttttatatcgctgtatgtatccaatacaaactggatcgcatagaggcttgaaaccgcgatcatcaaatgacagcggtcagttttttctgtgctgctgcgtatccggcccagatcactgtccagcctggacatcagataatagaggaatacggcgacgcttaaaaagccagccaataaaacaatttccatcagcatgcctcctttggcttgcggataaagaatgatttatatatggaagcacttttgaacatcgcgcagagttcctaaaacaagaaatgtactgtgctccggcaggcaggtttccggtttgatgacggtcatggagagcttcccgttttccttgatcgccagaatgttgacatggtaccgtttgcgcacatccaactgtccgatggtttttccggcccagctatccggtacagatacttcgaaaatagcctgatcgtccccaagtgaaatataatccgagatatgatcggagctgtatcggatagccgtccagaccgccatctgcttttcagggtatacgacttcatccgcgccattgcgcagcaaaaattttgcctgtacatcccgtgcggcccgtgcgaccaccttttttgcccccagctctttcaaaagggacgccgtttccagagagctttgaaaattatccccgatggcaacgatgcatacatcaaaattgcgaacccccagcgaagaaagaaattcttcgtcggtgctgtcgcctatttgcgcattggtaacaaagggaagcactgcgtttactctgctttcaacccggtcaaccaccatgacctgatgatttaattcgttcaatttttgtgcaatatgacgcccaaaacggccaagaccaatcagtagaatcgctttcataagtcctccttaaaaagacggcgtttccgattttataactgccttctagccaacggtgatccgctcctgaggcagcttcgcatttgtcgactgcgtatgggacatggtggcaaagatcaaggtcaggcctcccacgcgcccaaaaaacatgagagaaatcaaaatcaaatgggatacaatccccagctgtggggtgatattcagggacagcccgaccgttccgatggcggatgcagtttcaaacaggcagtcgagcaggggaaggttttccatacggctgatgatcagcccggctgtcaaaaataaaaacaaatacatgatcaagatggttgcagcctggcgcaccgcatcgttggagattcgccggttaaaaaaattagcggactctttcctgcggaaaacagccaatgagcttgccagcaaaacagccagcgtcgttgttttcataccgcccgcagtagaaccgggtgaacctccgaccagcatcaaaacagtcatgataaattggccgggttcgctcattgcagtcaggtctgcggtgttaaagcccgcggttctgggtgtaaccgactggaaaagagaaagcagcagccgctcgtccaaaggcgcctgcacaaactcaaaaaggaaaaaatagacggaagggattgcgatcaaggcgagggtaacggtgagaataaccttgctctgcatccggtattttcgaaaatggaaacgattcgttcgtatatcatcccatgtgagaaatccaatgccgccggtgatgatcagcagcatgatgacaatggagacaatcggatgatcggaataactggtcaatgacgaaaagggagctatgacccccatgaggtcaaagcctgcattacagaatgcggatatggaatgaaacagtgcgtaccatacgcccctgagcgtcccgaaatccttcaaaaaaatcggcagcagaatcgctgcacccagcagctcaataaccagagcggtctttaaaataaatccggtcagacggacaatcccgccgacatttggcgccgcaatagcctcctgcatggtgctgcgctgcatcagaccaattctgcggccggaaagaatggcgaaagcacccgcgaccgtcaccacgccaagccctcctatttggatgagcagaataatgataagctgcccaaagccggaccaataggtcgctgtatcgtgaaggaccaagcctgttacacaaacggctgaggtggatgtgaacagcgcgtccacaaagggagtccagatgcgctgttttgtggaaatgggaagcatcagcagaaagcttccagccagaattacgagcaggaatcccagaataataatctgaaaaggcgatgtgcgttttttctgctggagcggccgcataaacaccatctcttaatacctctttataaaatctttatacacccattatccacatcgggtctaaaaggggtattaatgttttataatccgcattaaaatggcattaagacgcgcggtgccgtgtattcatcctgccggaattccatgtatttgcaagttatgtattcttatagccatccgcacaacaaggagattggaagcatggcggccagtgtgcagataacaaccgcgagcagggtgagcagaggcagccctataaacattacaagaagtccaagcagcgggtgatgaagaataaaacgttcagcggttgtatcaaaacggttttcaaaacgggaaaacttccttttcagcgtatccataatgggttcctccttatgaacccattataatcaatgcaagcttaaactggggataagattgatggactgaggttaagaattaataaatattcaaaagaacaaggcgtccggcctgtggataccacgggatgaacgccttgctctttattgttttttgtgttgtaaaatggaccgcagaccccaaaagtcactggtttaacgggaacaaaattttcataagcacctgctcggcggcccctgtgtgatccacgccaaaataaagccgcttgcccaaaccatccagcagctcgaattggctgccgcggcagatgaattgtatatttaactgctccaggacgctgaaaagtgaaagcgtccattcgatccagttgggtgcgcactgattgacaagcgtatcccacagccattcaaattccggcgggaaaatccgtttttccaaaaacaggagccacaacttctgcttttgctccagggtcaggctgagcagacaggctaggggagcatcatccgggcagtcttgttcaaaataaacgtagcagaaggacagcgtgcggtcaatacaggccagatgctgctgttcgagaaaatcggcgtactcccattccattgccgctgcggggcgtccgtcctcaaccgcccggagcaagtcaaaaaggcagcgcgctgctttgatgtcaggcagaaggagagtcaggtacaaatcgcgcagctcgtcaaaccaaacgccggaaacgctttgctggcgcatcacaagactgtcgccgtcgccggcaaagctgattccgatcaactcgccgctgtctgcgatgccaaagacctcaagcggccaggtttggtctattttggataccaaggaaccaaaattttcagccagttcatcggttggaaaggacaacacctcatatccaatctttagctgtctgtcgccgtgacggtaaaaaactctgtgaggcagaccgagccagtcgttcagagattttatcaggcagatgatcagccaagcgggagaattttccacagccacggtctttggacaaatggtgcgttctatggtttgattgtagcgaaaccgcatatatgcgcctccgttctggcgattggttcatccccttttattgcttgccggcctcgcggatcagtcccatgctctctgcaatgtccaaattgacgcccagaacgttgacggtttcctcaccgaaaatgccaagcagcttgccctgcgtgttatcagccacaatctgttccagctcctgctggctcaggccggaggcttcagccaaagccggaatctggatttgtgccgcttgtggagagatatgcggatccaacccggagccggaggctgtcaccatatcggcggggatgtcctcgcggctgacgccgggattggcgtccaaaaacgcttcaatatccgcttgtacacgttccacaagggcagggttggagggcgcataattgttggagccggatccaaggccggaaaattccgtaccgtcgttgtaaaactgattgccctgggcatcctcgtagtaggtgttgtaatgatatgctgaaggacgcgttttcataaagtagggctttgtaaattcctgccccacatgggcggcgccgactggcgttccgtccgctgtaaccaggctgccatgcgcctggcttgggaaaattacagcggagatcccactgagcacgaccggaaatgcaaagccgcagagaaagagaagcagcagtgttacgaccacggcctgacgcacccagtggaggaaggcgcttttatttgtggtttcattcataagggatacctcctcagaagcccatccccatcacgcctaaaagcggggtgataaggatatcgatcaatttaatacctacaaatggtgtgattatgccgcccaggccatagatcatcatattgcgcgccagcatttttccagaggacatcgggcggtatttgacgcccttcatcgccagtggaatcaagcacgggatgataatcgcgttgaagatcagggccgacaggattgcgctgtattgtgtggacagccccatgatgttgagcatctgaagctgtgggatagccgtcataaacattgcgggaatgatggcgaaatacttggcgatatcgttggcaatcgaaaacgtggtcagcgacccgcgcgtaataagcagttgcttgccaatctccaccacttccaggattttggtgggatcgctgtccagatcgaccatattggcggcttcctttgcggcggtggtgcccgaattcatagccagccccacattggcctgggccaaagcgggcgcatcattggtgccgtcgcctgtcatagccacaattttgccttcggactgttcttttttaatcacgctgattttatcctccggcttacattcggctatgaagccatccacaccggcttccttggcaatggtggcggcggtcagcgggttatcgcctgtgcacatgattgtcttgatgccgatggcgcggagacgtgcgaaacgttccgtcatgcccggctttacggtatcctttaaatagatgacgcccaggatccggttgttttcacatactgccagcggtgtgcctcccagggaggatactctttcaacatgggtgtggagatctgccgggattttgccgccctgctccagtacatattgctcaatggcgtcagaagcgccttttctgattttggaaccatcgggcagatcgacgccgctcatacgggtctgtgcggtaaactcctggaaggaggagccatcggtttccacgctgttgtcccccagacggcgtgccagctccagagtggatttaccctcgggcgtatcgtcatggaggctggtcaacgcggcgcagcgaatcagatcgctgcggctggcgccctctacaggaaagaagtcggccgccagacggttgccaaaggtgatggtcccggttttatccaaaatcatggtgtctacgtctccgcaggcctccacggccttgccgctcatagcaatcacgttgaaccgggtgacccggtccatgccggcgataccgatcgcggagagcaagccgccgatggtggtggggatcaggcaaaccatcagcgcaatcagcgtggaggtctggagctgcactcctgaatagagcccgataggatacaggcttacaatgacaatcaggaagatgatggtcaacgacacgagcagggtatttaaagcgatttcattcggcgtttttttacgggacgccccttcaaccagggcaatcatccgatccagaaagctgttgcccggctcggaggtgatgcgcaccttcagccagtcggatacaacggttgttccgcctgttacggagcagaaatcaccgccgctttcacggacgacaggcgcggattcgccggtgatcgccgattcgtccactgaggcgatgccctcgatgacctcgccgtcattgggaatgatttcgccggcgctcaccaggacaacgtcgccttttttcagctcgctggaggagacgatcgtctcgtttccatccgcgtccagcagatgggcctgcgtttccttctgcgtttttttcaagctggcagcctgcgccttgccgcgtccttcggccacagattcggcgaagtttgcaaacaggacggtgatcagcaggatgatggaaaccaccagattataagtacgcacgctgccgtcggtttcaccgagcaggccggggaaaaaggtgagagccagggtgataaaaaaaccgatctccaccacgaacatcacggggtttttcatcatatagcgcgggttcagcttggcaaaggagccaaccagcgcctgccggaaaatttccggcgttaccagtttctgtttactgctcatttttatctacctcccatcaggaccaaagcgtcaaatgctctgcgattggccctaaagccagcgcagggaagaaggtcagggcggcgaagatatataccacaaagaccaggatcactgcgaaggaaaccgtctcggttttcagtgtaccgaccgactcgctgacaaacctctttttcatcagtgagcctgcgatggccaactgaatgatgatcgacagataccgtccgaagaacattgcaagaccggctgtaatattccaaaagtagctgttgtccgccaacccttcaaatccggaaccgttgttggccgccgaggaagcatattcatacagcacctggcttaatccatggaagccggggtttgtgatgccctccagccccgcagggacggctaccgccagcgcagagaaggaaaggatcagcagcggatgaatgataatgcaaagagcggtgagcttcatttcgcgcccctcgatcttcttgcctaagtactccggcgtgcgcccaatcatcagcccgcagataaatacggcgaggatggcgtacatgatcatattcatcaatcccacgcctttaccgccgaatacgacgttgagcatcatgtgaagcagcgggaccatgccgcccagaggcgtcagggtatcgtgcatgttgttgacggtgccggttgtgaaggatgtggttgttgtggtaaacatcgccgactgggcaataccgaaccgcacttccttgccctccatgctgcccatggactgatcgagacccacctgctccagcgccggatttccctggctctcagaccagaaacaaacgctcaggccgattaaaaagatgattcccattgccaaaaagatcgtgcggccttcccggccaataatcctggaaacgagagaacggtctttcgtgtctgcctgttcgttctggccggctgcgcgggcgcgtttgctgtccagcaccatcttgccgaatgtaataacgcaggccccagggagaatcatcatcgaatataattcgatcagattagagagaatggttgggttttcaagcggcgtcgacgagttggcccccaaaaagccgcctccgttggtaccgagatgcttgatgatttccagcgccgctatggggccctgcgcgatgatctgtttggtaccttcaatggtagtgactacagtattggcaatgaaattctgcggaacgccctgccataccagcagcaggccgccgacgattgaaaaggggatcatgatacgtgtggtaatacgcacaagatccacaaagaagttgcccacattctccttggtccgtccggcaagcccgcggataaaggctacgcaggcggcataaccggtcgacgccgatacaaacatcataaagatgatcaccagcatttgggagagatagcttaggccgctctcacccgaatagtgctgaaggtttgtattcgtcataaagctgacgatcgtgttaaacgcaagcgtcggctccatatcgccgatgccgttcggattaaaaagtccaatgtgctgaatacgtaaaatgagatatcctatgaataccataacggcgtttgttcccacgagggcaagcgcgtactgtttccagttcatacccctttggggattgacgccgctgattttgtaaataagtccgtcgacccggtcaaataccggatcggcaaaggtgtgcttcccagcggcgatatgatacatataccgccccaccgggatgacgatcaacagatatataatgatcgtcagcgcaagctgcagcataatcgttccctcctacttgactattctgatactaaaatttttccgggtgtaccagggcgtaaaccagatatacgcccatcagcagcacgatgccgcccaatatcaacatataaatcctccgttccaccgcactgcgcggtatcaatacaaatgaaagctcccccacggacggggatttttcctaccgcttttctctttatctcaagccggttactcctggttgtcattttgttgctggcaccatttggtcagcagccagaccagcccgaaacagacagccagcgttccgaccatcaagagatccatcatatgcgatacgccttcctttcctgagacattccgccgcgctgtgaacagggtttcccatatgctttaaaagcacggcaaggcttttttgttgcccccatagtatactgcaagccgtaataagcggggattaagggttttgacacggcgttaagaaaaaattaattttttgtccgcatcggtcactccaagccccgtcggtcgacagcggggagtgtaaaacggaataccgttcccgacggcctgttgtcggatacggtgatttgcccgttatgctgggcaatgattgaccggcagagattcagccccaatcccaatccccgctgacaatccgaccggccttgctccgcggtgtagaataaatcgaacagatgctttttcgcttcgtccggaatgccgggaccgtcgtcggaaatggatacctccaccatgtcccccttacgctcgccgcttaaaacaatgtgcgagccgttgggggtgtattgaatggcgttattcatgatgttgatgataacacgcaggatcagcttcgcatttatatttgccatcaacatcgggtcctgcagcacaatcgaaatattatgttcgcgcgcccggcggtccaactgcgttgccgcactttggaatatatcctccaaaagctgcggctccatggggagggcgcccttgtccgcctcaaggtgcgtcgctgccaacaggttttcagtcatactgatcagccaattcgtatcgtcatagatgcctgtgtacagtctttctttggccgcgtcatccagggggcattccttttgcatcaagatggacgcgctgccgctgatatttgtaagcggggtgcgcaggtcatgggatacggcgcggagcagatttgcctggaggtgctccttttgcgcctgaagcgcggcctggtttttttcctcctgcaagcgcagacgctccaggcttaaaccgcattcgcttaaaatggcgatcataaaatttttctcagaagcgtctgggatgggatatccggcgatcggaattcccacaagccccatggcgccccgcgcaccgcggacagacagaaacagccatttggaatccggcaatgtgttcgtcgtggcgccagcgtgtttattgtttttctggacccactttgccacgccgatttcctcggtggtcaattgcttcagtacccgtttttcgtccgccggctccacacgaaacgacagattttcatccggatggtttaaactgtataaaacgggccggtcaaaaagcctgttcaattgctccgcggccaattgtaagcattccaactcatttcggccctgctgaagcttttgactgctttccagcagcaattccgtgaaataacttttttgcgccgtcaactgcgcctgcgttttaacctggcttgcaagagagcttgcaatgaagctggaaagcagcatgatcagaaatgtgataggataacttggatcggtggcctggaaagtgaattttggttcagtaaaaaagaaattaaaggcagctacgcttaaaagcgagctgacggcgccatacaggtgtccgtttgtccagacggccgttaccagaacacccagaataaaaaccgtgatgatatttgattcgctgaagcctgcggaataaaaagtgaagcaaagcagggtggagatgagcagaacaagcagcattttccccgtgtccttccaggaaaacacaagctttttcctgtggatttttcctaggggttttttataaaggggctgctgatcagggatgatataaacatccagatcggtcagctcgattaaacggtcggccatgctttttttgcgggttatagaattagaccggtgattcatgcgccccatcacaattttcgttacaccgctgacacgggcgtattcggcgatctgtaccgctggatcggtaccgtataccgttgcaatctgagcgcccaattgttccgccagacgcaggttgcttctcagccgtttgatgttttctccggacagctctttggtttcaggcgtctgtacaaaaagagctgtaaagccgctgtgaaaggcctcggccatacgcgcggcggttcgtatgaccttggcgttggacggcgccgaggaaaggcaaatcaggatatgctcccccgcacgggcggtttgccccttccggtcatgtacagccgcccgattaagccggtccgccgttctgcgcatggcaatttcacgcagcgccgccaggttttccgcggtaaaaaagttctcaagcgcctgtttggcctggcgttcccggtagactttgccggcgcgcagccgtttgaccagatcatccggttcgatatccacaagctccacctggcttgccaggtcgaacacgaaatccggtatacgttcgttgaccactacgccggtgatggaagaaacaagatcgttcaaggactccagatgctgtacgttaacggtggtgtaaacattgatccccgcccgcagaagctcctctatgtcctggtatcgcttggtatggcggcatcccggcgcattgctgtgcgcaagctcatctacaagaatcaattgcggcctgcgctgtagggcgctgtccaagtcaaattccttcagtttgattccgcgatagtcaatttccttgcagtcaagcacctccagaccctccagcaatgccagggtgtccggacgggtgtgccgctccacataaccgacgaccacgtcgattccctcgttttttgcttgatgcgctgcttccagcatggcgtaggttttgccgacgcctgccgcataaccaaaaaagattttcagctttccgttggcggcgccggtcaccgtttcattattttccagaggcgctgacggatttttataatgttcatccatatggttctccttccgtatcattggagtggcgcaatgtctttttataattaagatagcacagcagacccaatgaaagcataaatcttttttgttttacattaagactatataaagacggtgtagaaatcccataccacagccttcccggcttagaaaaaccaccttgagccatgctgtcaatggatcaaggtggagcgggttcgttgaaaggataacatttaataattatattgagcggaaatacaaagaaaaagtccccggtttcctttttgaaaagaaaaccggggacttttgtcaatagagacgcagcgattggtcggtttggagcggccaacagtcccagacaaggtaaaaggtcagagcgcgcattggcgccaggtccttgcctggtgcgggaaagccatgacttcgggcgaaactgatttataagggtgctgtctcgccttgatggcacattccgcatataaggaggaacaagagagcggatggatggcttattttctgcaaaaggcaaaaaataagccggagcaaagtggactttgctccggcgtggtgccgctgaccgggatcgaaccggtacggtgtcgccaccgagggattttaagtcccttgcgtctgcctattccgccacagcggcataaatcttgcctccctctaatgataaacgattgtcggctaatagtcaagccgttgaagcaattccgggcatggttatatgcttgcaggaaaagagttgtgaatgcaggtataccggtacatttagaaggaataaatttgggttatcgaactttcatatagtaattttctgccgaatatgataatatagattatcggttgaaaccatgggacggtcaaaaacagattatgggaggcagacgatgattttcaaaaagaagtcgtattacgatgagatgccagagacagaaacagtaaacggggatacgcccgcacaggcacagcaggaaataccggccgagccggcgccggcctccgttgcacccactgggccggccgcgtccgggcagtccggcaaggaggatgggagcatgaatgaatcggacctgaccgcttcaatttccaaaaatacggttgtcaagggcgatattgcgaccaaggataatctggagattttcggccatgttgagggcgatgtgatcagcaaagcggtcgtgaaggtctatggcgttgtgcgcggtaagatctgctgtgaaacgttcgttgcgagcggcgcgaaaatctgcggagatatcacctgtacgcattcggttgtagtgcgcacaaatacggagatcgagggcgacatcaagtgcggttcggccaatatcagcggaacggttttgggcaatgtaactgctggggagatggtttctctcagcgagacggcgtctgtaacgggcaatgtcatcgctgctggtattgaagtcagcaagggtgcgattctcaacggctctgtcgagacgcagaaaaaggagccccccaagccaaaggaaaaagtgaaagcagtggagcaaaaagaaaaagtggaatcgaaaacggagacgaacgccgcgccgtcggctgagaggccagccggagaggcgcagaaaaccgaggaaaagattccggccgcagcggccaacggctccatataaaaaagaaccggcgagaccgccggttctttttttatggcgtttcacgacttttatttacaaattgcgctttacatttaatatagaattctatacaataaatttattcatatttttatacccggccccgcccggcgctggcaaaggatatccagaagctgccaggcggggcgcggaccataaagagaggggtttattatgccgcgcggacgcaaaaagacggtcaatttgtcctatgagcagcgtattgaagaaatcgagggaaagatcgaagcgcacaaaaacgcgatttctgatttgaaaaaggaattaaaacggttgacggctgagaaagagcaggccgatttggagaagatctgcgcgcttgtaaaggcgtcggggaaaacacccgaggaggctcttgccgttttaaagggagaggcatagaaagaaacggccgtgtgcggccgtctgttcctctttacgctggtttttattgacgaacaggtcaatttctgttatagtcaaagggaaaacaggggagccaaaaggctgagaatgagtgcaccgcattctaaaccctcgaacctgatacgggtaatgccggcgtaggaagcatatcgacacgattttgtgccagtttgttgttttacaaggggccgtaccaggggtgcggccttttgttctgccccgccatgcagtccgcccgaaccggcgcggccgcgcgccggttgaccgggacagacgctgcaacagaaaggaaggatttgcaatggggtacacaacgcagatgaacgctgcaaggcagaaaatcgtaacgaaggaaatgcaggctgtcgccgcctgggaagggatcggcatggaccggcttttagagctcgtcgcaaacgggcaggccgtcattccagccaacaagaatcataaatgtttaaagccatttggcatcggcagcgccctgaaaacaaagattaatgtcaatcttggcacctcccgcgactgcatgaatatggatgtggagcttgaaaaggtcatgaacgccgtcaatatgggcgcggaggccatcatggatttaagctcgttcggcgatacgcgcgtattccgccgcaggctgactgcggagtgcccggcgattcttggtacagtgcccatttacgatgcaatcgtctattacaacaagccgctcagggacatcaccagccgggagtggatcgacgtattcaaaatgcatgccgaggatggcgtcgactttatgacgatccattgcgggctgaacaggagcacggccgcgcgcttcaagcgatccaagcggctgttgaatctggtttcacgcggcggcagcttaatcttttcatggatggaactgacaggcaatgagaacccgtttttcgaattttatgatgatatactggaaatctgccggcagtatgacgtgacactgagtcttggcgacgcgtgccgccccgggtgtatcgccgatgcgggcgacgtttcacagatcgaggaacttgttgtgctcggcgagctgacggcgcgcgcttgggaaaaggatgtacaggttatggtggaaggcccgggccatatggcgctcaaccagattcaagccaatatggaaatccaacaaacgctctgtaaaggcgcgccgttttatgtcctcggtccgcttgttacggatgtcgcccccggttatgatcatatcacagcggcgatcggcggagcaatcgccgctacatatggcgcgtcctttctttgttatgtcacgccggcggagcatctgcgtctgccaaccgtcgaggatgtgaaagagggaattatcgcctccaaaatcgctgcgcacgcggctgatgtggcaaaggggctgcccggtgcggctgactgggattacaggatgggacaggcgcgccgcacgctcgattgggagcgccagtttgagctggcgattgatccggaaaaggcgcgccgctatcgcgcccagtcgcagccagagcactcggatacctgtactatgtgcggcaagatgtgctcggtgcgcaatatgaacaagattttaaacggtgagaatgtcgatattatggaataaccgccttttcgccggagaggagagccgatggacaagctgttggcccggtcagggcttctggatggaatcgataaaaaggatctgacgcatctgttcggctgtacgggcggccgcgagcgttcattcagcgcaggggagccgatctgcgaggaaggcggccgcccgtcagtctgcgtgttgctcgcgggctgcgcggcgtctgtaccggacggcatgtcccgcgtgttcgaaccgggcgatgtgtttttgtgcgatggcgcttccatctgtgccagggtgccttcacgcgccctggtgttccgcgaggaccgttttcgttgtgtgtgcggcgcttcatgcgcttatcaccgccggttggtcgaaaatcttgcaagtctgatttaacagcagttcgttaagcaaatccgcgcggcatttcagttttatctgcgccgcgtatcgcggcggaatggaggatttttatgagtctgttcagcagaaggccttcctttcaggaaggtctggaaacgtttcaaaaaacgccgggcgcggtgcttttggatgtgcgcacacctggagaatttgcggccggccacgttccggaggcggtcaacgcgccgctcggcgctttggagcgtatcgattaccagcagaacacgccgctgtttgtctattgccacagcggcgcgcgcagcgggcgggcatgtattctgttggagaaggcgggatatcatgccgttaatatcggcgggatcgcaggatataccggcaggcttgaccgctgatccgattttttgtttccggaactctgaaacgcttgagaatttccgctttttggtgtatgatgaattagaagctgcacaaatgggagacgcacatgtcttggcggaaaacatcccggctgaactgcgtcggaaaagcttgaaatccgcagggattcccacgctttccttccttgcgggataaaaaacttttccgcagatccatgcgtttttccaattggtacgcttcttatccgaaaacagaagggcaacgcgtttgacccgatttaggagcgagggacggtttcggagcaaaagaccgctatgatcggagggatgactgtgaaaaattatgtgatcacaattgcaaggggatatggaagcggtggccggaccatcggcaaaatgcttgccaaggagcttgatattcattactacgaccaggagcttctgcgcatggcgtccgatgaaagcggaatcagcgaatcgctgttcgcgcgcgccgacgaaagattaaagacgccggtgctctttaaggcagggcgcaaaagcgcctacacgggcgaaatcatcccgcctgacagcgtggattttacctcggagcagaatctgttcaactatcaagccaaggtaatacgcgatttggctgaaaaggagtcgtgcgtcatcgttggccgctgcgctgattttattcttggagagcgcgaaaacgtcctgcgcttgtacgtacatgcgcccttcgagtattgcgtgaaaaaggcgatggaagtgcacgcctcgtttgacgaggaggaagcgcgccggtatatccgccggattgataagtaccggcgggattattaccgctattttacggggcgtgactggaacgcggccgaaaattatgatctgtgtatcaacagcagtatgcttggatgggataaatgcgtcgcgcttgtcaaggcatatttggagattaaaatggcataatcactttgccatgaaaaaggggcgttcggggacggattttttagccgcctcccggacgtcccgttttttcgcccggccaaaatataatcctgtttgttttgctgatgtgtgataaagaagtaatagaagtgcaaaaaattttgccgttcctatccggcacttagctcttgtgtcggataggtcgggcggttattcgggcaagtccaccttgccaacaaaagaataataaatctcaatgtcctgcctgcgggtcttgttctcgtcatagctgcactcatgcacaacgattttctctacaaaagcggcgagccgttgggcatagcccggtataataaccgctttgcggttattataccatgtccgcgaagcggcatggtataattgcccatcaaaaggcggttgccgcgcaagcggcgagccgttgggcatagcccggtataataaccgctttgcggttattataccatatataatacctcaatccgccataataatcaaatattttataggccggtcataaaatatttacagtctgcctgtacatatctgtaaacgattctccccatctgtcagattcaaattcgatgcacccatttcatgtgcccaacatagtataaaacaaattcatcaatttgcgaggtgtcaacaaaatgtgttataacaatggttgcggcatgcagaactactgcggtaatggctgctacaacaacggctgcggcggctttggcggttatggctacggctcctggctctggattatcctcatcattatcatcatctttggtttcggctgctgctgacagccggacacacccaaagcggcggccccggattaaccggggccgccgtttttgtttaccgcaggtcaggccgaataatccacatcatactcccgtgcgacctcaagcgaggctggctctccatctatgtaattgacacggacagaataactgcttccatggaaatagctggaggagccatcctcacggtcctctgcgtcaggcacatgttccttcagtacggcgggagttaaatctggcagcgccaccccgtcaaagctgacgccctcgagcggattgtcaagctccgaatcaatcttgacggacgcaatcacagcatcttgcacggggacgctctccttttcagtcacgagagccaatgtaacgcgcttgacagcatccttcatcatatagacgccggtataataagaatttgcatccatcggctgcgacgggctgatatccgccgcgccaatcatccccggcgccacgcttttcatcgtaaaaccggcgtcaaacaggacgcccgccttcgtttcgccgacaatgatctccgtaccgtcgatcgcaaccggatacgccttgtcgcttttactggagcacgcagacaatgcgaggcacaaagccgccagcattgccagaacaccgcccaatcccaatttctttttcataacacaacctccatcatgatcagcggttctgcatccgccgtctatttcccgcaggcacacagcaaagcagccgtgattccgtcacgatcagatcgaccggcacgtcatacctgccatgccaaagacgtgggcgcaggttatgcgcatagatcacgccgatttttggacctgtatattgcgacaggaaccggtcatagtaccctgccccataaccgagacgatagccgcggcggtcataggcaagcgccgggacaatacagatgctgccctcaaagtcctccaaaagcacgcagcgttcacggacaggctcaagcacgccgaaggtctgcgcagcaaggtcctccagagaatgaatcagaaaaaattccatctcccgccggccttccacgcagcgcggcgccgcaacccgcttgccgtctgcaagcgcgcgctcaatcagcgcgatggtatccacctcaatcggcttggaaacgtatgtcagcaccgtgccgcacgacgcgtattcgtgcagccccgtgacacgccgcaaaatccgcgcgtccgcggcctgttttttctccggcgtcattgcgcgcctccaatccttgatctccgcgcgcagccgctgcttgagcggccggatatctacgccctgcattgcagcgccgcccggatctctccggcgcgcgcggcatccgtcaaaacctcgacaagcttgaggccaaaatcgaccgcgacgcccattccgcgcgccgtcacaaaacgcccgtcgacgcagacgtagtcgcccgaaaggcgcgccgcgcccaattgatcctgaaaaccgggattggccgtcgcctccagcccgtccagcaggcctttatgccccaggattgagggcgcggcacagatcgccgccagccacaaaccgttctgcgccgcatagtcgacaaaccgctgcactacaggcgacgcctccagattcggcgtaccgggcacgccgcctggcagcacgaccatctccagaccgtctatgcgcgcctcgtcgtccacaagatcacagacgaccgtaatcccatgcgatccggtgatctttcggccgcccacaccgacagtctgaacctccaggcgagcgcgccgcagcacatcgacggcggcgagcgcctcgatctcctcaaagccttcggccagaaaaacataaatcataaactgcctcctcaaattctgaaatcaaccgctgtttcggccggcggcacgccgttatcccttcttttaatcgagcacaaggctgatgtagggcgcgcgtccgggatgctcaaacacccgctcacgcgctgccgcgtcataccagcaggtcacgcccgccgccacgcgttcaagcggaaaaggacaggccatatccggtggcagggtcagatgatattcatcggcgttgtatttgctttgcagcacggacagtgccgtgcgcacatccatgccgtcgagcgcaagctctttgacgcgcacgctcccgccatcgttgcggcagaccgccacagcccgcgtcccgcccgcttcaagcagaagcgtttcacccccgccaaaggccgtttccgtcaaacgataggcaagcgcgtcgccatcccaccgtacaaacatcgtgcgcccggcaaaagcgcgctcacgcagcagcatgaattcagaggcggtcgcctccgagatggcaaagctcttttcatacggcataatccggtcgcgcgggacaatcgcgcggccgctgtaaaattccgtatcaaagccgcgcttgccatagaaattgtaaagcgccgcgtttgacggcacgagcacagacagcttgacgcccgcctcgcgcatcgccttgtgcgcggccgcaagaagctttgtgctgatgccccggccgcggtatgacggcagcgttgcgacggcgtaaacatagcgcgccggcagaataccggcctgcgtcacaacggtcatcggaagcagcgaaagcatcgaggcgatatggtcgccgtcaaggaacaccatcgtatggcgcgcggcgtcgtgctgttcaaaatacaggtccacatatgcgttgctgtccccaaaacatgcgctccacagttcccttaactgcccgcgcatcccctcgtctgcgaaacggatcatgcgttgtccctccccgcgtcactgttcggtcacaataaatttttcaagcaggatcgccggcttataggaaagcttggcccgccgaagcccttcgtcgcccacatcgtcctcacggttgacatatttgaaatcggcgcagttatgcgccgcaaattccctgttgatcatcggatacgcgccagccacatccgaaaatgccttttcaatatggacgatgaacgtatccgaattgagcggcaggcccatcgtatacgccacaacgcgcccgtccacacgcagaagtccgccgcgaaggccgagcgccaaaaaattttcaaagcagttgcgcacagcgcacagctcctccatcaagctcggatcctctccgcagccgttttgctcgcaccaccgggtattcatactccagcattcgtcaatattttcaggcgtgatcgcctcaaacgaccagccgccttcatgttccgcctgaaaacggttgataaaattgcgtttgctgtgcagctttttgccggaaagggtaatcagtttttcaccttcataaatatagtcgaaatgatcccgcgtctcctcaaatgtgaagcgtcccggaaacagtgtttccaacgccgcagcgctctcctttgtcaccccgctcatcacaagcggctcgccgcgcagcgcggcgtcggccgacagcgcatcaatcaccggctttacgtcgccgctgccggacggaaacagatacgatctgggctgaccgtcccggccggaacgcacgagatagtaatcattcatgcgcgcgacctctatgtgataaagcttgcggtaaataaaattgttggagaatgtatactcgctgccgcggaaattccccatgcgcagcagcggatcgatccacgccttgtccgacaattcaatcggtttgaaatccaataccataaatgaaaattacccctttagaacctgtattcacagtcgccaagcgccgtccaggcggacctttcgcccccgcttggcgttaaatttttttgccgggcggcagcccgcctgcaaaaattcgccttgatcgggggcaagactcctcgcccgccaggcatcctccggctgtgaatacaggttcttatttgttgccgtccatcaggaccttccagatacattcggcgatcgccgccggtgaaaacgcctcgcggccgtctgaacagcgcaccatactccagccgcaccgttcagccgcgtaaagcgcacagacgcggcagcggcgcatataggcggcgtttgcctcatgaatatccttttttgccgcatccccgccataccgtttcatcagcagccgctccgacacatcgggatgcatatccaaaaacagcacggcgtccggttttggcaggccaagcttttcgtattcgaaatctgcgctccaatctataaatgcatcccactgtccgcgcggcagcttacccatttggtgaatcagatttgacgtcgcataacggtcggcaatgatagtatgccccgccaaatagtcatccttccaatatccgacatagcttgcaaacctgtcgaccgcataaaaactgctcgccgcataggccggcacgtcgtccgcctgtccaaattcgcccgccagatactgcttgacgagcgccgatgacggatgcgtataatccgggaaactgatgccgcgcgcggggacgcccgcgcgcgcaaagcggtccagaagcagggcggcctgtgtctgcttgccggctccgtccaaaccgtcgatcactatgagacggcccttcatgcgtcgtcctccgccttcacgccatggatgcgcgcgatatgcgcgcgcatcccgcgcgcgtcgccgcagctcattttcccttcatggcacgcgcctgtgtaacacgatggtccggccttcgaaaacagcgtcggcgccaccctgcatacaagtaaaagcatctgatcggccacctcacggatttcccactgcgcgcgcttgcagcagcgatgtgcaaagaagttcagcaagctgcgcgcattcattgtgacgatcagtttggtgtcacaggcgtttggcagcacaaaacgcgcgtcctcaatcgcctgcttctccgcgcggcgcatggccgttttttcatcgtcgccgttcgcgatgaaagcggctgtatgccgcgcctttaaaagcgcggcgatccggtcgtaatgcgcctgcgcgtcgcgcatcgcctcctcgaaagccgcggccgcctgcggatcggcctcgatttcaggcggaacgacgtaatcaaactgcgcctcgcgcacataccgctggctctgcacgctgtacgatgcgatccgatggcgtgtaagctgtgcaaggaaagctcgtgagacgccttcaatgccaaatgtaaagctcgcgtgttcgatcgggctttcatgaccgatcgaggcgagcatctgcacgaagtcggccgccttctcatcggtaaggctgtccattaaatccgcaagcgacgccggcgaataacagagcttcgccgccgccgcgatggttttttcaggcgcgggcgtgtggctaatcagcgtgacccgcaatttagccttcggcatttgactctcctcctgtttttcatttccagcccggtgaaaccaaaagacacgctgcctttcggcttcaccgggcaatcatggttacttcccgtttacgcaaaggccggtcgggccgtccgcgctgtgaatcagagctgatcgcactccgaaagcttcggggggaaaaactgattgaccgggaatttgatcttcttaaagacctcgcacggatcgtccgttgtgctggtgctttccttgtcgggcacacaataatcgtatgccgggatcatcatctgcacgcagcgttccagttgaacgatggtgaacaggccgattgtaatcagtacgaccttctgcggcttgcacacggcgaaatcgccgtcgaatttggagcagatcgacgccggaagcgtcacgccgcactcgaacatacggcctggaccgcattccaccagcttggaatcgagacacatcgggtcgacgacatgcacgctggctttgggcatattggtgttgtcgtgctcgcagcaattgcgcgcgtctgtggagcagtaaaccttgacgttgccgtcagacccgtacaggattaccttcttggcgaaggcagcgacgccgacaaccgtcgcaggcgggatcgtcggcgaggaatacgcggcgacagtcaccttgaaaaagaatgtgatatcgaccgcatagaagcctttgttaaacgggactggctcaacatccagataagcggtcaggatttccacatccttgcacttgacactgattgcgttatcaatcaccggctgcgcgcggtcggtgaagtagacctgaagatcggtcaggcaatccttgtcggtacaggaatcataaatccttccggcatctatgcatactgcttccttaaagcagttcgccccggttgcggtaacaggggccgtcttttgctctgccatatgaatcctcctagtaatgttttgagctgtactcaatacattttatgagcattccgtttatttgtgcatcagcagagaaagttttcaccggcgctgattgcctgccgggcgtttttttccgctttaagtcatgcttcttgcagcaaatagcgcctatccgctcgaaagggaccatacggaccgattttgcatctccgtaagcgcagagcagagccggtgcgtgtctccgccattttgacagaagcaaattgccttgaccatgaaggggaaaataatcgccccggccatatggggataaaataaatgccgcgcatttattttatcatgaccgcagcgcggcatgataaaattggccatcagggcggcagcgtgccgcgcacgcgtatcgccctggccatatgaagataaaataaatgccgcgcatttattttatcatgaccgcaggcattcgtcaatttacctgactctggcaggccatcttttcgcttatcgactctgcgccgccctttccgactgcccatgccgctaaaatatcatatgaaaaagccgtgctttgcacggctttttcacaatacaaaacgtattttgggaaagcaatccacaaataggttcctagtccaatccggcaagtatccggtatgtacgttccagcaaacgggtcctatacccgatttccgccgtacggccgtccaggcgcgccagcgcaggggatgtgtagcgcgcaccagcctcaaacagagcctccatgcggcttctgtttcttctgatccgtttccagttccattcaatcagagaggccaacatccacattttaattttcgccatccggcaacccacctttcattcattcgacagatagtcccgccgatcaacaaaataattatacgcaaagtaattggcgcaatttgtcgaacaacaggagatcaccgtgaataaactatgaagaatcgacggatcattcgttaattcctgcgcaatcgcgcgaatttcgccataaccttctttgttccgacagattcgaacgctacttcgacaagctgatcgttacccatcggcgtaacagacaaaaccatgccaggtccaaacaccttatgcacaaccggatcgccaggcttccaatcgcattcgcccgcctgcgcagccggtgcatagcccacgccgagcattctgtccgcctgcgtcatgcgcgggcggcgcggcggcagattttccaccatctgccgccgcagaaccgtttggtccgtcacctcgcacaactgctgcggcacctcgcccaaaaagcgtgacggacggtttcgcattgtctggccaaacagcatcctctgcgccgctgtcgagatataaagctgcttttttgcacgcgtgatcgagacatatgcaagcctgcgctcctcctcaatctgttcgggattgttcatcgcctgcatccccggaaaaagcccttcctcagcgccgactacaaatacataatcaaattcaagccctttagcggagtgcatggtcatcaataccaccatatcagcggcagaatcgtagttgtccaaatccgtgtaaagcgatatctcctccagaaagccagataaggacggctcgtctgtttcctcctcataacgatgcatcgtggactttaattcctcaatattttcaatacgcgcctgtccttcaggcccttgtgcctgaagcatacgcagataccctgtttcctcaagcagagtatccagaagctcatcaagcaaaaccttgtctgccaaatcgaccagcttttgaatcatggaggcaaaggacatcaaatcctgtgccttgcgtccaagcgatgcatattcatcggcatgggccaacacatcaaatacggttttcccctcgcccgccgcaagctctgcaacagccgcaatggtgctttcgccgatttttcgttttggctcgttgataatgcggcgaaggcgcagcgtatcggcctggttgttaatgacgcttaaataagcgacgacatccttaatttccttgcgctcataaaatcgcagtcccccaatgattctatagggaatcgcagctttggtcagaccgcgctcaatcgcctgtgattgggcgttcatgcggtaaagcaccacatgatcggcatagcgcgcgccatttttaacattctcctgaatggtatcgcagagaaagcgcgcctcctcgccttcatccgccgcgcgatagacgcgcaccttgccgcctgtatcattttgtgtccagagcgtctttccctttcgggccgtattgtgttcaatcaccgcgttagccgcgtcaaggatcgtacctgtactgcggtagttctgttcgaggcggaacacacgcgcgcccggaaacgtatcctcgaactgcaaaatattctcaattgtcgcgccgcgaaatttgtaaatactttgatcgtcatcaccgacgacacacagattcccgctttcagaagcgagcaggcgcaccaactcaaattgggcgtgattcgtatcctgatactcgtcgaccatcacatagcggtaacggcggcgatacgtctccagcgcatccggatattgctggaatacccgcaccgtcagcataatgatatcgtcaaaatcgacggcattggcgttttcaagctgacgctgatacctctcatagactttggagacgacctggagacgatagtcctcccccacggtcgctgcaaaatcggccggtgtgcgcagttcatcctttgcacgtccgatttctgacagaatggaccttggggaaaagcgtttctcgtccacattcagctctttgagagccgctttaatcaagcgtatcgaatcgtccgtatcatagattgcaaagctccggccatatccgatccgctcaatctcacggcgcagaatacgcacacacgccgaatgaaaggtcgatgcattcacatccgaagccacggaccccagcatcgcagcaagacggccgcgcagctccccggccgctttgtttgtaaaagtaatggcaagaatattccagggcataaccgttcggtttcgaatcaatgaaaaagcacggtccatatcccagctttcaccggcagcatactcctccaaaaacgcaacgtcatcctcggttaaatgctccggcacatgtgcacttgtatatgcgtcgccaaattgaatcatatttgcaatgcggttgataattacggtcgtctttccgctgcccgcgccggcaagaatcaacaccggaccgtcaaccgcataaaccgcctggcgctgcattggattcattcggataaaaaaatcgtcgatgatgcgccgcctgacggataaaaaacgttctgacaatgattgttccatatcgctctcctcaagtttttcctaataatcagtttgtttcaatccattataccatgtccgcgaagcggcatggcataatcggccacctgggcgcaagcaggccgtgcccgcgcatcgccctggccaaaatttggtataattgcccatcaaaaggcttgccgcgcaagcggcgagccttttgatgggcataaccccggtacaataaccgctctgcggttattgtaccccctttcgggcttgtctgccgctttgcggcagcaaaaccggctttgccggttttattgtggtgaaatatgcgcagcccgctgctttgcagcggttgccgccgaagggcggccgcaaagagcaaagctgttttccatgcgcatattgtaccacactttgccctgcctgtgaacgagaaaaggacggtcctgcggaccgtccttttgtttactttgatcgaattgctgtcttaaacaagcggtttgaggatcgccagcagaacgccggcggccacagccgaaccgataacgccggaaacattcggtcccatggcgtgcatcagcaggaaattcgtggggttctccttctgccccaccttctgcgaaacgcgcgccgccatcgggacagcggaaacaccggcagaaccgatcagcggattgattttgccgccggtgacaaggcacatcagatcgccgagcagcacgccgccggcggtgccgatggcgaacgcgcacaggccaagggcaatgatcttcaatgtctgcggcgtcaggaaacgttccgcgctggcggtcgcgccgactgtagtcccaaggaaaattgtaacgatattcatcagctcgttctgcgccgttttgctcagacggtcggcgacgccggactcacggaacaggttgccgagcatcagcataccgatcagaggggccgtatcaggaacgaggaaggaaacaacaaccgcaacaagaattgggaacacaatacgctccagcttggaaaccggacgcagctgctccattctgatcgcacgcattttcttggtagtcagcagcttcataatcggcggctgaataatcggaacaagcgccatataggaatatgccgcgatcgcaactgagccgagcaggtgcggcgcgagctgtgttgttgtaaagatcgccgtcgggccgtcggcgccgccgatgataccgatcgatccggcctccgggcctgtaaagccaagcagcagcgctccgaagaaagcgataaaaataccaagctgcgccgcggcgcccatcaaaaagctcttgggattggcgatcagcggaccaaaatccgtcatacagccgacaccaaggaagatcagcggcggataaatgccgagcttgacgcccagatacagatagtcaagcaggccgccgctgtttccgagctgctcccacaggatatgccccgtatcgttgatgaagatctcgggatggtacatatttgccatcggcaggtttgtcaaaagcataccgaacgcgatcggcaacagaagcagcggctcaaagccccggccgattgcaagatacatcagcacaaatgaaacaagaatcatcagcgcctgaccgccagtcagattcataaaacctgaaccgctgatcagcttctgaactgaatccaggaaaatctcaagcatgttgtcagccctttcgtttaaaatgcggtttttcgtccgtacatgccattactgcccacacaggcagcgccgccgtttaaaacggctgcgtgttctgggcaagtcctgcctgcgaccacgccgtgcgttcggcgcggcggatgctgcgaacgacaaatccgctctcaggggcgggcccttcaacagccgggacgggaattaccggagaaccggtcattgcggcgatcgcagccgtgatcaccgctacaatctcgtcaccaattccatcctcaaccgccatgacaggctgctgtgccacaggcgcgggcacctcggcggcccgggcgacaggcggctgcacagacgcctgctggggcgctgccttcggcggatccttcggcgccggcggcgctggctgaaccggcttctgcggctgctttttctgcgaaatcgccgtgaaaatcttgcccatgatggccacgatgaaccacaggccgatcaatgcgacaaacacgacgacgagtccggtgatgataaccgcacccgcaagggtcatattttccataataattctccttgctattttatttttatgtttattaactacaattcaattgctttcctcaaaaaatcgaaactagaatttattatacaatatcttgtggtgatatgcaattgcttttccaaaaaattttgaaaaaattttaacaaactttggcctgttcatttccacgtacacaatttagacataaaaagcgccgcccatataggcggcgctttgtgaacttttactaatcgaattacgtaagcgatttcatgtagcgttcgtatgcctcgcgcagctcctgcgctgtctgctccggacaggtcggattgcagtgcgcccaaacgccggtttccgacgaggcgttgtatttgattttgtccgcgctgcgcatcggcggaaaaaattcaatgtggaagtgatagctgtcgtggacatccggcccattgaccggcgcgttgtgcatacacatcatatatgggaacttgcagccaaacagactgtcgagcataccgaccgtgtgcttgaccgtcacagccagcgcacggcgctcctgctgcgtgaactcatccagattgctcttgtgcgaattggcgaagatataaacgccatacggatattccgtaaagaacggcaaaaacacggtgaagtgttcattggaaaagatgacgcgcttttgaaaatcaagctccgccttgagcatatcgcagaacaggcagcggcccttttcttcaaaataaccgccggaggacgcaagttccagctcgatctttttcggcacgaatgagtagccgtagatctggccgtggggatgcggcatcgtaacgccgaccgcctcgccgcggttttcaaagataaacacatacttgatcctttcatcctgccgcagcgcgttaaaccgctcgcaccacagatcgaccagcttctccatatgatcgtccgaaagctccgggacggttgtcgtatgaccgggcgaataaaggatcacttcgcattttccatatgccggcgccgttttaaaaaaatcgttggccacatcgtcgggcgcgggcgggtcctggctcaacgccggaaaatcgttgtcgtatttatagacgtcataatgctccggcaccttgccggagccgggacagaacggacaccagtccttgggcatctgcggccgtgcctggcggtgcgacgcgatcatgacccaatcctgtgtaagcggatgccatctcaattctgccattgtcgattcctcctgttcatcagttcctgtcatgcgccaagctttggtgtgatctcaacgccgcccacaggacggatcgaaagcacatgacagcttcccgctccaaagacggactccatcttttcccggtacgcttcgagcagatcgtccggtacaaagctctgtatggtgccggcaaagcctccgccgtgcacgcgccacgcaccgcgtcccgcaagcagatgttcgctcatggccaacgcgagcgaaagcccttgctcgtccggatttttgcaggtataaacgttttgcagatacataaacgatgagcggccgctttcaatgacaagcgccttgaacgtctcaaaatcgccggcgcgcagcgccgcgacctgacgcggcacacgcgcgttgtcgccgtagaagtggaaggcgcgcagcagcgcgcggtcggtgcatttgccgcgcagcgaagcaacacgctcgtaaaatgtctccggcgcgatatcccgcagcacctctttgccgagcgccctggcgacggaacacatctcgacagccgccgatgcataatcgtctgtcagatcggcgtgattgcctcccgtatcgacgatgcagagcttgtagccggaacgcgcaaagtcaaaatcaaccttttcaacaacaggcttctcagggtcggcgaaatcaatcgtgatgaacccgccgactgaacaggccatctgatccatcaggccgctcggcttgccaaaataaacgttttcggcgtactgtccgatctgcgcaatctgtatggcgtcgaccgcaccatccgcatacaggctgccaagcatcgttccaacgatcgtttcgaacgcggccgacgacgacagccccgagcctttgagcacgtttgaggttgtataagcgtcaaatccggcgaccggatgtcccatcgcagcaagccgggcggccacgccccggatcagcgcagcggctgtgttgcgctcgtcatcgcgcgccgacagatccgacaaatcaaccacatccatcggaaagccctccgacttgatgcggatgatccgatcgtcatttttagacgccaccgcaatcacatcgaggttgacgcccgccgccagaacacgcccgtgctgatgatccgtgtgattcccgcccacctcggtgcgtcccggcgcgctgaacaggcggatctcacggcccgcgccgaacaatgtttcaaactgcagcgccgcatttttatagcgcgcgcgctgctcctgcgctttttcgctgtaaagatagccaaacgcctcatcaaatgcgccgctgtcaatccttgtcatcgtctcgatcgtatccatctgttgacctcccatcttttggatgcgtctgccggatgtcacgtccaaaatttcctgtttcctatagcttaacgcaaaggcggccctattacaacagaaaaaacaatcatttttatggatttttgttgcgccggcgcatagacttctgatatgatgtcaatagacattcatgatggcgggagggcgtaaacatggcgtccgggattttcaagcattcctataaaacaaaaacgcgcgaaagcctgccgattgcaatttataacgccggagcgcagcggtgcgagccgttgtatgcctggggaccgggcctgcgcgaccattttctggttcaccatgtgatcgccgggcgcggcgtttacacggccgacggcgttacgcatgacgtaaaagccggcgatacctttatcatttatccatctgttgtcgtaacctacagcgccgacgcagccgatccctgggaatactgctgggttggcttcaatggcgcggaagcgcgtctgatgatcgcacagactccttttacacgccaacggcctgtcgtccggtttgaacagcctgatgaaatccgcgaagccattgccgatatttaccgtgcgtcgggaaccacgcgatcaagcgaactgcgcgcaatcggaatgctatacatctttttggccctgctcatcgaacaggccggcgcgcccgcgccggccgccggactgtcgctggagtatgtcgaaagcgccatccggtttatcgcacataactattccggacatatcgacatcgaagcggtcgccgcctctgtcggcatcagccgaagccatttgtaccgcgtctttatgcagcatattggcacgccgcccaacgagtaccttgcaagattccgtatttcacaggcgtgcgagctgcttggccattcctcgctgcctgtttctgcggttgccgcttccgtcggctacgacgatccgctgtatttttcacgcgtatttaaacgaatcactggaatgccgccgtcagcctatagcaaagcgcaccaggccgggacttaagcgccctaacgaccgcaggccgcatctttttgcggcgccgtccggcggctgcattccaaacgcaaggaggcttttccatggaaactgatatcgcgaatgctcttgaaacaaattcaaccgccgccgaaatccaaagcgcggtcgacgccatcgcacagatgccatcgaacacacggctgcactatcttcttggaaaatttttagatctgctgcccaagctcttgacggccgcgctgattctgctggtcggcatcatccttgtgcgctgggccgcaaaatttgcgcgcaatctgctcaagcattcccgtctggacgtgacgctgcataatttcatcgtttcaatcctcagcgcgctgctctatatcctgttggccattatcgttgtaaccgtgcttgtgccttcggccgccgggtcgctgatcaccatgttcggcgtatttggccttgctgtttcgctggccgtcaaggattcgctcgccaatctggcgggcggcatgtcggtcctttttacaaagccgtttgcacttggcgactatgtcaatatcaacggcaacgagggaactgtccaggaaatccgtctcaactatactgtgattaaaaccgtcgacaacaagctggtacatatcccaaacggcgatgttgccaaggcggagatcacaaactttaccgcacaggagacacgccggctcgaccttgtattttcaattggttacgacgatgattttgaacaggccaaaaaaatcatccgtgaaattgtgcatgacaatccactggcgcacagcgaccctgaaccgattgtccggatggtggagcacggcgattcagccatccggatcgggtgccgtgtctgggtggatacagccgactactggacgctgaattatgatttgcttgaggaggtcaagcggcgttttgacgccgccggaattcatattccatataatcaattggagattgcgatccgccgcgagccgtagtattttgctccggccgcgtcagttgtaaacgcatgggcgcgccaaagcgtccgttttttaagaaaaggcccgggattttcccgggccttttttctgcacgtccactgccggaaactcggaactgaatccgactggccgcacaggaagtaatgagggcattttgaagccgtgccagcatccaattgtcccctcttgattatatatccaaataatttaaatttcaatctaaatattaatctaaaatttaattgtatatttagtttataatcttgtctataatctggacaggtgatgttcatgtttcaaattgaaaagccggaaaaagtcaaccgcaccatttttatccccaaaagcctgttggaacggattacaaagctttctcaggaaaaggatgtctccgtcaatcaaatcattattcaatgctgtgaatatgcgctttcgcatatggaggatcgcggcgcggagccgaaaaaataagccggagcgcgaccgctccagctctttcggtcaaaccgaggctgtattctgtccgaaacggcggcggcacgcatcgatctgcgcctgctgtacaggttctgacgtgtaccagccgcgtttaagcatttcatcaaatacctcgtgctgaatttgatgttcctcattcagaatcgtcatcagctcccccataacggcgggggaggcgcattcatttgcataaaggttataaccgtgcgctgcaaacttctggcttgccagcgcatcctccatcatctcgcggtcgccgaatggaatttgccgcatactcacttgccgcctccctgcccaagctgcgcaagcagccggttgtaatgattctgatggcgcgccgaattgttttcaaactgtgtgcgcagctgcggatctgaagccatgtgcgcatacatggtgaattttttgatcagcgtttgttcaacgccaagctgatcctcgatcgcggccagttccttggcggttagcgacatatgaaaaacctccctgaattggtatcgctaaaagtatgccaattcagggaggtttttatacagccgccataaccgctcgctgatttcaaaacctgtattcaatttttatgcggcgacgatgtgataaagccgtcgaccagccggccaatatattcaaatgaccggcctgtaccgatcgcaacgcattccaccggattctctgccagtccaaccggcatcttcagcttggcgctcatgtgcttgtcaagcccatgcagcatcgcgccgccgccggtcatcaccatgccgttttcatagatatcgccgacaagctccggtggcgttcgctccacaacagaatggaccgctgcgcggatctcctccacaagttccagcatcaccggatacagttccgaacgcgacagctccacgcgcgtgggcagacccgtcgccaaatggcgccccttgatctcataagacagattctccgcgtccgggtcaacgctcgcaatcgcaatttttacccgttcagccatgcgctcgccgatcagaacattgtatttgctgcgtacatagcggatgatcgcagcattaaacttatcgccggccaacttgattgaatttttacagacgatcccgttgagcgacagcacggcgatatcgctggtaccgccgccgatatccaggatcaaattgccgtttggctttgaaatatcgattcccgcgccaatcgcggcagccaccggctcctcgatcaagtaaacgctgcgcgccccggccgccccggctgcgtcaacggcggcgttcgcctccacccctgtaatcaacgacgggatacacagcgcaacgcggggcttgaccacattgcttgggcaagccttcttcataaagtatttaatcatggcttccgtcatcttataatcagaaatgacgccgtcacaaagcggacggatcgccgtaatgcgggcgggcgtttttccaatcatctcatgcgcctccgcgcccacgctgagcgtttcgcccgttttcgtattgaccgcgacaaccgacggttcgcgcagaacaattccctgcgaaccattgtaaacaagcaccgtcgaggtgccaagatcaattccaatgtcaatcgaactcatgtttagacctcccgccggtttttatccggcatcttttgtccggaatgaatcgcgttatgtcccaaaaggcaaactgataaacctgccgtaacacggcataattaccctggccataaaggtgtatcattgcccatcaaaaggcgattgctgcgtgcacaccggtataataaccgctctgcggttattataccatgtccgcgaagcggcatggtataattgcccatcagaaggcggttgccgcgtaagcggcgagccgttgggcataaggcggtataatgaccgcgctgcggttattataccatgtccgcgaagcggcatggtataatcggccattggggcggcagcgggccgcgcccgcgtatcgccctggccatgaggtgtataataaccgctctgcggttattataccgcatttttcgccttttttcaacgctgcattttgccgcctctgcgcgcacgcggcgtcgtcatcgctgtgaccacataaacggactgcgcgccgcgttcaagcagcagcgcggcgcagcggcgtaccgtcgcgccgcttgtcagcacatcgtcgataagcaaaactgtcccgccgtcaatatgcttgcatttacaggctgcaaacgcctggcgggcattggcctcgcgcgcatcaaagcccttctgctccatctgcgcgccgcccagtcccgtatgcacgataaattcatcggatacaggcagtccaagccgtttggcaagcgcccgcgccagcagctccgtctggcaatagccgcgctggcggcgttttttcgggtgcattggcacataggtcacaaaatcgaacgggatatctgcaaagtcagcgcgcacacgccgctccatcaacgcggccaaaaatggagcgtaatatgaccggccgtcgtatttaaagcggtacatcccctcccgcgcgccgccggtatagagcagcggcgccgtcgcaccggcataaactggatcgcatcgccagcagatacaatcggctgcgggctttccacagcgcgtacataacacgcccgcatacggcggcacacactccccgcacagccaacccgttcctgcaagcacacgtccgcacagaaagcatttatgcggaaacaaaagcgtcaatacctgctcccaaaacgcgtcagccaccgcacacctcgtcgagcaggtaacgcaaattcgcataccggcgcgaacgtttgtggttgtccaccatcgctttaacggccgatgccgaaccaaggataatcaacagcttttttgcacgggtaatcgcggtataaagcaggctgcggtagtacatccggctttttccctccatcagcggcagaatcaccgcatcgtattcattgccctgacttttatgaacggtgattgcgtaagccaattcaagctcattggccatatcgaatgaatactccgccaggcggtcttcatcgaaccgtacaacaatcgtggcgctgggccggttaatcaaatcaatcacgccgatatccccgttaaagacgcccataccgtcctccccgccatccttctgccaaaccagatcgtagttgttacggatctgcatcactttatccccctcccggaatgtgaccggcccggaaacatattccttcttattgggggacggcgggttgaccgcattttgcagcacgcggttcagctccgctgtaccggctgctccgacacgcgtcggcgcaatcacctgaatatcccacatcggggaaaagccgtaccgcttcggcaggcggcgcgcgcacaagtcggcggctgtcgcgcaggcatgcgccgccaaagtatccggcagaaagaaaaaatcattgtcacgcacatcaagccgcggatattcccctgcgacaacggcatgtgcatttgtaacaatcaggcttttggccgcctgacggaatatctccgtcagatgcacaaccggcagatggccgcctgcgatcagatcgcccagaatattgcccgcgccaaccgatggaagctgatccggatcgccgacaagaatcagcctgcatgaaaatttcagcgcgcgcagaagcgattcaaacagcagcgtatccatcatcgacgtctcgtcgatgatgaccgcgtcaaaaggcagcggattcttctcgttccgtttaaattttgtcaagcccgatccatcggcaaaatcaacttccagcagacggtgaattgtttttgattccgcacctgtcaattccgacatgcgcttggccgcacggccggttggagcagccaaagccaccttttcccccatctgcccgagcagccggataatcgccgagatggccgtcgttttaccggtgccgggtcctccagtcaggatcatcagcggcgatgtgaccgctgtaacaatcgccatacgctgaagctctgcatagacgatgccgctttcacgctccagcctgccaagaatctcctccatatccggcgcgcgctccgcagcgcctttggagagcatcagcgacaatcgattgacgatacagcattccgcctcataatagcgcggcaagtatagaaagctgcggtcctttacagccagccgcacaagctcgctgcgcgcaatcagctcctccaacgcgtccgaaacatgataggtatccgtctcaacaagcagcgcggctgtctccagcagcttttcttccggcagacaggtatgcccgttatgaaagacattgtggcgcagcacatgaagcagccccgcagagatccgttcatagctgtccggcgccaatccactccgttcggcagccgcatcggccagctcaaacgggacaccgatctcctcgatacagagagaataaggattttctgatacgatttcctgtgccgcagccccatattttttccatgttttgatagcatatggcgcgggaatccccaatttttcaagatttaacattacagatcggattccaaaaagtttcttatactcattggaaatttgttccgctttcttgggcgaaattccctgcacctcagcgagctttgccggattttgttccatcactgtgagcgtatcatcgccaaaggcacggaccaatctgcgtgcgatggcaggcccgacgcccttaacagcgcccgacgacaggtagcttgcaatcgcggaggcggttgccggcatcaggcgttcatacgcttctgcgcgcagctgcataccatatttggcatgcgttgtataggcgccggttacaatcaatgtctcgccaaccgcaatatccgaaaattcgcccaccactgtcaaaagctccgcttcagttgacagctccagcacagtaaatccattttcctcgttgtggtaaacgatcgtctccacgctgccttccactctgtaacgctcgccggcctccaagatttccgttcctccccgctctgttctgctttgttccattataatacagatttcgcggattgtaaacgcgcctgcgggctctggcgcgcgcgacccgtgcgcgggtcgctcaccgccggccgctgcgcttgcccggccggctattcggggctttccggcgctatagcgccgggcgcggacaagccgcggcagcgccccttttcgcgcctcacgggataggggcgggccgcccctgtcccgtggacccaaccccggggcaggtacagcctgtatacgcgcagcgcccgccccactgttcgcggcgcagccgattaaagtttttcgccgaagccttttttcaaaaaggctggagcgcagccggctaaagttttttccaagctttttttcaaaaaaggtgggaacgcaatcgggcgtcaagctcggatggagagcagataaaggctgcgccggcactttgagccagagccgcgcagtcgcgcgcgccggcttcgtcaagcccaacatcataaagaataaaggattcacggcttggattcgactcccactgcaaacaggcgtaaaacagcgacatttgatcgcctgcgcgttcgccgccgaccggcacaattttgtaaacgcgattacctttacggcttaaacgaaccgcaatccatgccgccgtatgtacaaatccgatacaagccagcgccacaaataaaaaccagcaaactgtgtcgatcataaaaaatcacctcgaaaccatcgtatgttccgaggtgattttgtgttcacgaaaatttccgcttattccctgacagccgctaaaatcgcatcaactttatctgttttttcccagtttacgccaagctcctcacggcccatatggccataagcggcgagctgccgatagatcggacggcgcaggtccagagaacggataatgaccgccggacgcaggtcaaaaaccttgttaacagcctcggcaagcttttcatcgctgacggcgccggtaccaaacgtattgacgttgaccgaaacagggcgcgccactccaattgcataggcaagctgcacctcgcagcgatgcgcaagctttgctgcgacgatgttcttcgcaacccaacgcgctgcatatgcggccgagcggtcaaccttggtcgggtcctttccggaaaacgcgccgccgccatggcgtccgaatccgccgtatgtatcgacaatgatcttgcgcccggtcagcccggaatccccctgcggcccgccgataacgaaccgtccagtcggattgacataaatctttgtatcagcatccatcagccccgcgggaatggtaggcttgatcacatgctcgatcacatcggtgcggatctgctccagtgaaacctccggcgcatgctgatttgaaataacaaccgcatcgacgcgcaccggtttgtcgtcaacatattcaaccgtgacctgagttttgccatcggggcgcagataggcaagcgtaccatcgcggcgcacctgcgacagccgcttggccagcttgtgcgccagggaaatcggcatcggcatcagctccggcgtctcatcggaagcatagccgaacatcatcccctgatcgcccgcgccggtcgtatcagcttcgtcgcaggcgccttctcgctgctcaagcgccttgtcgacgccctgcgcgatatcgccggactgctcgtcgatgcttgtcagcacggcgcaggtctgagaatcgaagccaaatttggcacgatcataaccgatatccttgataacgctgcgcgcaagcgccgggatgtcaacatagcaggacgttgaaatttcgcccataatcatcaccatacccgtggtgacggccgtttcacacgccacgcgcgcgcccgggtccttggcgatgatcgcgtcaagcaccgcgtccgaaatctgatcgcagattttatcgggatgtccttcggtcacggattccgatgtaaacaaatactttgtcatatagaatgctctcctttctatcgtgacggccctccctggcctggtcaatcaactcagcagcgccaataccccgtcgccgatggcgttggccgtgcgataaatcccctgccgggaagccatgctgtcgtattcggccggattcgttacaaatcccatctccaccaataccgacggcgcaaaggtattgagcgtcacacggaaatttgactgtttcggaccgcggttggtgcgcgaggtatattcagacagatttgcggacagcgttgctgcaagctcttttgcgatactctcgtaatagtaaacctctgtgccgccaatcttgttcatatcctgggaatagttcaggctgttgcaatgcagggaaataaagaaatccgcctcataagcgcgcgtcaaatccatacggtcgttcatggatacatcgctgtcatctgtgcggcacatgaccacatgcgcgccaagggattccaaacgcttttgcaccgcaatggctgaagcgagcgtgatatccttctccattgcgccgtctgtacccggaatcccgatcgcacccggatcagtgccgccgtggccggcatccaccgcaattgtcacgccggccaagggttgaccgcctccggacagacgcggcgcatatttcgcatagatcagcgtattcccatcctcatagctgatatcgtatccccacagccggcgctgaccgctgagcataaactgcaaaaccgtactgccgtcctcctccgtaaccttcaccgagctgaataatccgctgtcagcgtaaggcttgatagattcgacacctgtcgtattataaagacgcacaaacagtttttccccatccatataagcgcggaacatgggattggccgtcccgtgcagcgtatatgtctcgcccttttctgaaacgtcaatcgttacatcggacaccttgttttttaaagaaacactgccggtgagcggacgcaccgacgaacgcggaatccatccgccggttgaaagcctatacaggtttcctttgatctccgcgaccaaatcggtgccgccgcggcgcggcgattcaataaaggcgctcatattttcatccagatagaggctcgcggccgcatttttaacctgaaccacaagacggccgtcgccgttgataaatacgctgccctcggaggtggcggacgccgtttttccattgtactgcatcgtgtaggtgacagggcccagctcctccgtcccgttagcggacggcgcagttaaccgcgccgaaaatgtagcgggaacgcctgcgcgggccgtagccgccgcctgtttgagcgaaaccgtgcggccgccaaccttggccgttaccgttgcgcccgacggcgcaatacacgataaagtgatctcatcgcccgaataggccgcacagtcgtagtccggcgctggtgaacgcacgtcgctgatggttgcaaccacgtcagcgcccttggtgatattgactgtggctgaagcgccgccctgacggaacacaaatgtattcacaccctcgtcaatcgacacaagcacgccgaagctgccgcccgcgccgcgaaccgcaacagtttccccgttcattgtcaacgattgattcgggtcggaattacctgtgataaaatagctggaagccgatgttgtcagatcgtccgcaggacgcgtaatctttaattggccgccagtatgcaaattgacatggcttgtaatataatcaaaatcgttatagctgtctgccgcccatgccgccggcgccatccccaaacaaacgcacagcgcgactgaatagctgagaagcttcttgccaaatgaatgatgctgcataaaaaaacctccttcaaaaccctttttgcagcgcgtccgccaacggctggacatacgccatttacgcagtgcgaaaaaatcgacagattcctgcgcagagcgacaaaaaaacgcccggttgaccgccgggcgtttttatacatcctcatctctcggtcataccgctggatttggcaccttgcaatatgcaggttgccgggcttcacagggccagtccctccgccgctctttataaggtagaagcatatttattttttaattctgattttattctacacgatgcgcgcggctttgtcaagcgttacaccgtctgaatctcaaaccggacaagacgtgctacaggtttataaaccaaataagtcaccgcagcattgatgcctgcttttacaaggttaaagggcacaatcaccggcagcagcatggggataacagcgtcaatcggagtgcccataaagatcggcgtaaaaatcaggttgcagccgaccatgacagctgtcatcgcaagcacgcctgcaaccaaagccaaggccgcgccgccgcgtgtatgacggcggcggtagatcgtccctgccagcagcgcaaaggtaccggtcgccagaaagtgcatcacgataccgatccaccctgaacctgcgctgacagtcgtcccctggataatcgctacaaccgcagtcaagccaagccccgccgccggaccaaacaggaatgtgccgatgaagatcgggatgtcagcgggatcatattccatccatggcgccgccggcagcagcggaaaatgcacgaatgccaccagtacgattgaaatcgctgtgagcatagccattgtggtgagtttgcgtgtcgcttcggttactttcatatgtgaccctccaaattatgttggagcctgccggggaaaatgaaaacacccctgcgcgcagcgcaagggcgtgggcatatcggcggaaatccgcgaatacatgccgtttctttcatccggactattaccgttggtatgggagtttcacccattcagccggctttcgccgggtcgcggactttaccgccagtgaggacttgcacctcgccctgaaacagacttttttcataatttattatagcacgctccgcgccgttgtcaagtatatttgataaaaatttgacgatatgttccacaaaacaagcgccccgcatttggggcgcttgttgataaaaaccttattcgttgatcttggtgacaacgcccgaaccaaccgtgcggccgccctcacgaatcgcgaaacgcagaccttcctcgatcgcgatctctgtgatcagctcaacgtccatctcgacgttgtcgcccggcatgcacatctcggtgccttccggcagcgtgatgacacccgtgacatcagtcgtgcggaaatagaactgcggacgatagttgttgaagaacggggtgtggcggccgccttcttccttcttcaggatatagacctggccgcggaacttggtgtgcggatgaatggaaccgggcttgcacaaaacctgaccgcgctcgatttcggtgcgctgaataccacggagcagagcgccgatattgtcgcccgcctcagcgtaatcgaggatcttgcggaacatctcgatacctgtaacaaccgtctttttgcgctcctcggtcagaccgatgatctcaacctcgtcgctggtgcgcagctggccacgctcgacacggccggtcgcaacagtaccgcgtccggtgatcgtaaagacgtcctcaaccggcatcaggaacggcaggtcggacttgcgctccggagtcgggatataattgtcgacagcatccatcagctccttgatgcagtcgtaagccggatcgttcggatcattggaggcttcgagcgccttgagcgcggaacccttgatgatcgggatgtcatcgcccgggaattcatacttggagagcgtctcgcggatttccatctcgacgagctcgatcatctcctcgtcgccgtccatctgatcgaccttgttcatgaaaacaacgatcgcaggaacgccgacctgacgggccagcaggatatgctccttggtctgcgccatcgggccgtccgtaccggcgataaccaggatcgcgccgtccatctgagcagcgccggtgatcatgttcttgatatagtcggcgtgtccggggcagtcaacgtgcgcatagtgacgcgcatccgtctcatactcaacgtgcgcggtgttgatcgtgatgccgcgctcgcgctcctccggagccttatcgatcatgtcataagcctcgaactgggcctggcccttcagagacagatacttggtgatcgcagcggtcagcgtggtcttgccgtggtcgacgtgtccgatcgtaccaatgtttacgtggggcttggttctttcaaaatgtgcctttgccatcgaaaatgttcctccctttaataaaaactctttgtttcaggaaaataggttgctggcgctgaaacgacacgccttgtctatgatttgtattctaccaattcacaggaaaaaaagcaagcattattcggcttttttgccgcgcgtgctcataattccctcggcgatcgacttgggcacctcaatgtagtggctcggctccatgacatagctgccgcggccctgcgtcttggagcgcaggtcgttggagtagccaaacatctcggaaagcgggacgaacgccttgatctcctgagcgccgaaaacggcttccatgccctgaatctggccgcggcggctgttcaggtcgccgataacgtcgcccatataatcctccggcgtattgaccgtaacgcgcatgatcggttcaaggataaccggatcggcctttgccatcgccattttgaaggccatggaggcggcaatcttaaacgccatttcagacgagtcgacctcgtgataggaaccgtcgtacagcgtaaccttcacatcgacgaccggataaccggccagaacgccggcctgcatcgcgccctgaataccctgatcgatcggcccgatatactccttggggatcgcgccgccgacgatcgcgttgacaaactcatagcctttgccgctctcgttcggctcaatcttgatcttgacatgaccgtactggcccttaccgccggactgacgggcatatttgtggtcgacgtcggccattttgcggatcgtctctttataggcgacctgcggcttgccgacattcgcctcaaccttaaactcacgcagcaggcggtcgacaatgatctccagatgaagctcgcccataccggcgatgatcgtctggcccgtttccgcgtcggtataggtgcggaaggtcgggtcctcctcggccagcttgctcaggccaatggccatcttttcctggccggccttcgtcttgggttcgatcgccaagtcgataaccggctcagggaattccatggactcaaggatgatcggatgcttggggtcgcagagcgtatcgcccgtcgtcgtgtttttaaggccgacggccgctgcgatatcgccgcagtaacacgtttcaagatccttacgatggtttgcgtgcatctggaggatgcggcccatacgctcggaattctgtttattggaattgtaaacggacgttcctgcatcgaccatgccggaatagacgcggaagaagcagagcttgcccacatacgggtccgtagcgattttgaaggccagggccgcgaacggctccttatcgcccggcttgcgctcttcctcctcctccgtctcaggattaattcccttgatattcggaatatcggtcggtgcgggcatgaaatcgacgatcgcgtcgagcagcttctgcacgcctttattcttgtaggacgtaccacagcagaccggaacaatcgcgttggcaatcgttcccttgcggatggccgccttgatctcgtcggtggaaatttcctcgcccgcgagatacttctccatcagcgcttcatcctgatcggccaggctctccagcagttcctcacggtactgctgcgctttctcgatcatatcctccgggatctcctcgacgcgcatgtcttttccgaggtcgtcataatagacgtcggctttcatctcgatgaggtcgatgatgcccttaaagaatgtttcagcgccaatcggcagctgaatcggaaccgcgttgcatttcagacgcttgcgcatcatatcaataacgtggtagaagtccgcgcccatgatatccatcttattaacgtatcccatgcgcgggacgttgtatttgttggcctgacgccaaacagtttcggactgcggttcgacgccgcccttggcgcagaaaaccgtaaccgagccatcgagcaccttcagcgaacgttcaacctcaactgtgaagtcaacatgtccgggtgtgtcgatgatattgatgcggtggcccttccagtaggctgtggtggcagcggacgtgatcgtaatgccgcgctcctgctcctgcgccatccagtccattgtcgccgtaccttcatgtgtctcaccgatcttgtggttgattcccgtataatacaggatacgctcggtggtcgtcgtcttaccggcgtcaatgtgggccattatgccgatattgcgtgtcatttccagagatacatctctaggcatagtgtcctcccttatttcttgcgctccgacgccggttcagcagccgctgacgccgccggtaaaaatcaaggcgcataggttgcgccgccgtcaggcggcgtgcaggcggaaaactaccacctgtaatgcgcaaacgccctgttggcttccgccatcttgtgggtatcctcgcgctttttgacggcgccgccggtctggttgagagaatccatgatctcgccggcaaggcgctctctcatggtcttttcaccgcggttgcgcgcatatgtcgtcagccagcgcagaccgagcgtctgccgccgctccgggcggacctccatcgggacctgataggtcgcgccgccgacgcggcgggccttgacctcgaggacaggcatgatgttctccatggactgctggaacgcttcaagcgggtccttacccgtcttttccttgacgatatcgaatgcgccgtatacgattttctgcgcgacgccctttttgccatcatacatgatgttgttgatcagccgggtgacgagcttcgaattgtacagcgggtccggcaaaacgtcgcgttttgcaatttgacctcttcttggcacttcgcttccctccttcacaattataatgaaatcattggtactcgaaagtgacaaaactcccgttcgcgccaatcatcggcccatctatatggtagccaatcactggcagaataatcagcagttttattacttcttggcaccagccttcggacgcttcgcaccgtatttggagcgggcctgcatcctcttggcgacgccctgcgcgtcaagtgtgccgcggatgatgtgataacgcacgccaggcaggtccttgacacggccgccgcggatcagaaccacgctgtgttcctgaagattgtggccgataccggggatataggatgtgacctcgaaaccattcgacagcctgaccctggccactttgcgaagcgcggagttcggttttttcggcgtggatgtacggatcgccgtgcacacgccccttttctgcggcgaagtctgatcgatggcaaccctctttttggcgttccatcccttgagcagcgcgggagccgtggatttcttggcagtcacttccctgcccttacgaacgagctgattaaaggttggcatattgcacctccttacaaaaaaatgtggactttatttcacggggcaaagcggctgctttgccccggtgaaaccgtgtctgcgggccaatcccacagtatttgattatagctctttcaaccacttgttgtcaatacatacagtcagattttacatatttcgtatgattgcacaacaaagctgtctcatcaggcgggctgcatatcgtcggcgccgctgatgttggcaataaactcgtagtcgccgtggtcggacggtccgcccgcgttcacaagctcgagtgaatcataggaaaccgtgccggtgccggccgggacaagcttgccgatgatgacgttttcctttagtccctggagcttgtcgaccttgcccttgatcgcggcctcagtcagcacacgcgtcgtttcctggaaggaagcggccgacatgaagctctccgtcgcaagcgacgcctttgtgatgccaagcagaaccggcagccctgaagcgggacggcgcgtaccgccgtcctcggcgtttttacgctcaatttcagcgttgacgcgcagaagctcgctcttgtcgacatttgcgccggtaatcagcccggtgtctccgccgtcgtcaatcttgaccttgcgcatcatctgacggacaatgacctcgatgtgtttatcgttgatatcaacaccctgtgtccggtaagttctctgcacttctttgatcagatagtcctgaacggccagatggccggaaaccatgagaatctcattcggctcgaccgcgccttcggtaatcatgtcgcccttgcgcacaacgtccccttctgagacgcgcagtgtcgatccatagacgacctgccgctcaaagcgctcgccgtcgtcggcggtgacgacgacaaagtcgccgcccttctgatctttctcgaaggagacgattccgtcgagatgcgaaatgaccgcgctgtttttcggcttgcgcgcctcaaacagctcctcaacgcgcggaagaccctgtgtaatatcggcggcggacgcaataccgcccgtatggaatgtgcgcattgtcagctgcgtgcccggctcgccgatcgactgcgccgcaatgatgccgaccgcttcgccgacgcccacaggctgcccgttggcgaggttcgcgccgtaacatttggcgcagacgccgatttttgattcgcaattgagcggcgtgcggatcttcagctctgtgaagcccgccgccttgatgcgctgcgcgtcggcctcggtcatcatctgatcgcggctgacgatcagttcacccgtattcggatcgatcacgtcgtcggccgcatagcggccgatcatgcgctcgacaaaatcctcaatgacacggccgctgtcgacaatgtcgcagacgacgatgccctcatgcgtgccgcagtcatgctcgcgcacaatcacatcctgcgaaacatcgaccagacggcgcgtcagatagccggaatccgccgtgcgcagcgccgtgtcggccaggcccttgcgcgcgcctcgcgaggaattgaagtattccagaatgttaaggccttcgcggtaattcgccttgatcggaatttcgatcgcacggccggatgtgtttgcaatcaggccgcgcatgccggcgagctggcggatctggtccatcgaaccgcgggcgccggaatcggccatcatatagattgggttgcgctcgtcaagggtattttgcagcgcgtccttgaccttggccgtgcagtcgttccacgttgagacgacacgctcgtaccgcacatcctcggagataaagccgcggtcatactggcgcttgatcgcatcgacctgcttgtcggccgccgcgatgaactcggccttttcgggcgggatgaccgcgtcgtaaacggcgacggtgatcgccccgcgcgtggaatatttaaagccctgcgccttgatgcggtcgagcacctcggccgtcttggcggtcccatacgtgcggatgcagcggtcgatgatctttccaagctcctttttgcgcaccaaaaatccgatttcaagatcgaacacatgctccgggtcgttgcggtccacatagcccaaatcctgcgggatggggtcgttgaagatgatgcgcccgaccgttgtgtcgatgatatgcgagacgcgctcatcgccgacctggcgcgtgacacgcaccttgatcggcgcatgaagtccgaccgcgcccgcctgatacgccatggtggcctcgttgaagtcgcggaacaccttgccggcgcccggctcctcctcgcgcagcatcgtcagataatacgagccgagcaccatgtcctgcgtcgggacggtgacgggctttccgtcggacggtttgagcaggttgtttgcggcgagcatcaaaaagcgcgcttcggactgcgcctccgcggaaagcgggacgtgcacagccatctggtcgccgtcgaagtcggcgttgtaggcggtgcagacaagcggatggagcttgagcgcgcggccctcgacgaggaccggctcgaacgcctggatgccgagcctgtgcagcgtcggcgcgcggttgagcagcacgggatggtccttgatgacgacctcgagcgcgtcccacacgtccttgacgctcgcgcgctcgaccattttgcgcgcgtttttaatgttggtggcaaccttgagatcgaccagacgcttcataacaaacggcttaaacagctcgagcgccatttccttgggcaggccgcactgatacatcttcagctccggcccgacgacgataacggaacggcccgaatagtcgacacgcttaccgagcaggttttgacggaaacgtccctgtttgcccttgagcatatcggacagcgacttgagcgggcggttgctcggccctgtgaccgggcggccgcggcggccgttgtcgatcagcgcgtcgaccgcctcctggagcatacgcttttcgttgcgcacgatgatgtcgggcgcgccaagctccagcagcttcttcagacggttgttgcggttgatgacacggcggtacaggtcgttgaggtcgctcgttgcaaaacggccgccgtcgagctgaaccatcgggcggatatccggcggaataaccggcacaacatccaggatcatccactcgggccggttgtggctctggcggaacgcctcgaccacctcaaggcgcttgagcagtttgacgcgcttctggccggcggctgtttcaagatccgttttcagttcctccgaaagcttgtcgagatccagctcggccagcagctccttgaccgcctccgcccccatgccggcgcggaaatcgtcctcatacgcctccttgaggtcgcggtattccttttcggaaagcagcgtatattttttaagattcgtaacgcccggatcgatgacaatatacgacgcgaaatagagcaccttctccagcaggcgcggcgacatattgagcagcagccccatgcggctgctcgttcccttaaaataccagatgtgcgaaaccggcgcggccagctcgatgtggcccatgcgctcgcggcgcaccttggagcgcgtgacctcgacgccgcagcgttcgcagaccttgcccttgtagcggatgcgcttgtaacggccgcaatagcattcccagtccttcgtcggtccaaagatcttttcgcagaacagcccttcacgctccggcttgagggtgcggtagttgatggtttccggcttcttaacctcgccccacgaccactcgcggacaaggtccggcgacgccagtccgatttttatcgattcaaatacattaaattccaaaagcgaacccctcttttcttttgcaagcggcaatttcggtcgttctgctggttttagaagctgtcgtcattggcgatcccgttaaggccaagctcctcaatcgggtcgaagctttcctcaatatcatcgtccgccaggtcgacgtcgagcaggtcgatatccgcgtcagcgtcggcgtccggatccggatgctcgatatcaaagccatcctcaaactcggacgggacttcgacgccgtccatcagcgcatcgtcaactggggtcaaccccatattgtcgtcgtcgtcaaaggtctgcttgagatcgatctcattgttgtccttgtcgagcacgcgcatatcaagcccgagtgattgaagctccttgatcaagaccttaaacgattcagggatgcccggctgcggtacgtttttgcccttgacgatcgattcaaacgtcttgacgcgtccgacaacatcgtcagacttgaccgtcagaatctcctgaagcgtataggccgctccatacgcttcgagcgcccagacctccatctcaccgaaacgctggccgccgaactgcgccttaccgccgagcggctgctgcgtaacaagcgaatacgggcctgtcgaacgcgcgtggatcttatcgtcgaccaggtgatgcagtttgagataatacatatagccaaccgtaaccggattgtcaaagagctcgccggtacgaccgtcgtgcagccacgtcttgccgtcgcgggaaaggcccgcctgttccaagcagtcggcgatatctgtctcgtccgcgccgtcaaagaccggcgtcatgaccttccagccaagctccgccgccgcgcgcccgaggtggacctcaagcacctgtccgatgttcatacgcgacggaacgcccagggggttgagcacgatatcgagcggacggccgtcgggcagatacggcatatcctcctgcggcagcacgcgcgagacgacgcccttgttgccatggcggccggccatcttgtcgccgacgctgattttgcgcttctgcgcaatgtaacagcgcacaaccatattgacgcccggcgaaagctcgtcgcagttttcacgcgtaaagacctttacatcgacgatgattccatattcgccgtgcggcacgcgcagcgaggtgtcgcgcacctcgcgcgccttctcgccgaagatggcgcgcagcaggcgctcctcggcgttcagttccgtctcgcccttcggcgtgacctttccgacgaggatatcgccggcgcgcacctccgcgccgacgcggatgataccgcgttcgtcaagctcgcgcagcgcgtcgtcgccgacgttggggatatcgcgtgtgatctcctccggcccaagctttgtgtcgcgcgattcaatttcgtattcctcgatatggatcgaggtataaatatcatcttttacaaggcgctcgttgatcaaaacggcgtcctcgtagttgtagccctcccatgtcatgaagccgacgagcatgttgcgcccaaggctgatctcgccgcccgccgtcgacgggccgtcggcgatcacctgcccgacggaaatttcctcgccctttttgacaattgggcgctgattgatgcaggttccctggttggagcgcataaacttgatcaggtggtatgaatgactttcaccgcggctgtcgcggatcacaatctcgttggccgagacggactccacgacgcccgcgtgcttggaaacaaccgcaacgccggagtcgaccgctgatttatactccatgccggtcgccacaatcggcgcctccggcacaagcagcggcaccgcctggcgctgcatgttcgcgcccatcagcgcgcggttggcgtcgtcgttctccaaaaacggaatcatcgccgtcgcgacagatacaaccatcttcggcgaaacgtccatatagtcgaccttttcgcgttcacagaccattaccgcgtcgcggtaacggacgctgaccttttcattggcaaatttgccgtcctccgtcagcggctcgttggcctgcgccacgatatacatatcctcgatatcggccgtcatatactcgacctcgtcgaggacaacgcccgtcgccttgtcaacacggcggtacggcgcctcgacaaaaccgtattcgttgatctttgcaaacgtcgccagatacgagatcaggccgatattcggaccttccggcgtctcgatcgggcacatacgtccataatggctgtaatgcacgtcgcgaacctcgaagcccgcgcggtcacgcgaaaggccgcccggtccgagcgcggaaagacggcgcttatgcgtcagttcggccagcgggttggtctgatccatgaactgcgacagcggagaggaaccgaaaaactccttgatcgacgcaacgaccggacggatgttgatgagcgcctgcggcgtcacaacgtccatgtcctgcgcctgcgtcgccatacgttcgcggatcacgcgctccatgcgcgaaaagccgatgcggaactggttctgaagcagctcgccgacggaacggatgcggcggttgcccagatggtcgatgtcgtcgacagtgccgatgccatggccaagtccgcacaggtagatgatcgacgagaagatatcgtccttgatgatatgcttggggatcagctcgtcgcggcgggccgcgatggcctcgcgcagcgcgtcctcgccatcgcaggcgtcaagaatttcgcgcaggacagcgaagcggaccttttcgttaatgccgagcggggcgcagtcaaaaccgacaaagtccttgatatcaaccatgccgttggaaagcacgcgcatctcgcggtcgtccccgatcctgatataaaccgtgtcgacgccggccctgccgatgcgttcggccaattcacgcgtcaaaacggtatcggcgccggcgagcagctcgcccgtcagcggatcggcgacggggcgcgatgtggtgcgcccgagaatacgcggcgtgatagccagcttcttattgtatttatagcgtccgaccttggacagatcgtaacggcgcggatcgaaaaacagcgaatcaatgtggctctgcgcggaatcgaccgtcggcggctcaccggggcgcagcttgcggtagacctcgagcagcgcctcctccgtattggccgtgccgtccttttccagcgtggccatgatgcgctcgtcgtcgccgaaaaagtcgatgatcgattcgttggaactaaacccgagcgcgcgcacaaaggtcgtcaccggcagcttgcggtttttatcgatgcggacataaaatacatcgtttgaatccgtctcatattccagccatgcgccgcggttggggatgaccgtcgcggtgtaaagctccttgccgctcttgtcgtgggacgatccataatagacgcccggagagcgcacaagctgcgaaacaatgacgcgctccgcaccgttgatgataaaggtgccgctgtccgtcatcagaggaaaatcccccatgaaaatatcctgctcttttacctcgcccgtttccttgttgagcaggctggcacgcacgcgcagcggagcggcgtaggtcgcatcgcgttccttgcattcctcaatggtgtatttcggcttgtcgtcaaggtgataatcaatgaaatcgagcaccaggttgtcctgataatcggtaatcggcgatacgtccttgaacacctctttaagcccttcgtcaaggaaccactggtaggaatttttctgcacttcaatgaggtttggcatctgaagaacctcatcgatgtgggaaaaactcatacgcgttgtctttccctgcgttaccggcttcacgttcaccataggcttcgctcactccattcgtctgttttgcgcgaatcattttacttccccgcgcgcatccggacgcgcctgaaccgtccgcggcgggcatctatctcataatgttatgcaatttagacaggatttcccacaatttacccatctattttgcaaatcactattgccaaatttgtcgatctgtgttattataattgtgcatccttgcgcacctatctattttgatacagtatattagtttaccacactttgtcaaacctgtcaagaaaaatctgtggacaaattgtaacaaaatcccgcgctgtcggcgcgggatttttccacatttaaccatatttgcatcagttcgtcagatgccatcggagagttcatacaaatcatacgccctcgaaaagccggtacatcagcggcatcagcacaggcgccagtcccgtcagcaccacgccggatataacggccatcagcgcagtttcctcatcggtggcgcgcgcaatcgcgggcagcgttgtgtccatagcggtcgctcctcccgccgcgaccgccgtataacgcccaaaatgacgcgccgcaaagggaataaccagaaacgccagcacttcatgcagcatatgcgtcaaaaacgcaatcgtcccaagctgcgcgccgccaagctcccgcataatcaccgccgagatgctgtaaaaaccgaaccccgatccgatggccgcgctctcattgaccggcatcccaaacaacagccccaccaagaccgcgccggtgatggatgcggcggccaccccgaacggaatcacaaggatgcgcacattgtattcacgaatttttcggaataccgtcttgttcgttccgacctcgattccgaccgaaaaaatcagcactgccagcgcatacgacatcaccgtgtccatcacggcgatcacttcgggcggaaatataaaaaggccgcacagcagcccgagcgcaaggcttccaagcgccgctgcgatcatctctcatcgcccgcctttcccgcatccttcgggaatacgagacgagacagtatgtacaccatcagcaccgaacaggacatcgttgccactgcaaacacagccgcgcgcaggcccgccgcgcgcaaatccgccagaaacgttggactgccggccatcgacgcgcccatcgaaaacagcgtcagcgaaatgcccgctgtctgcaacaggctgttagccttgagccacttgagcggaaaaaccgtcacgccgatcacgattccgatcaggaaaaaaacgatcagtgaaaacggtccgagaaaatcaaacaagcaaatccttccttttttaacaaatcaagcgcaggccgcgccggcacagccggcgcggcctgcgcttttttgcggcgttttgcaaaacgccgcactctttcaatgcttactgcgcttcgatatacgctttaaacgcacggtaggtctggtatacgtccgccttggagacgacctcgaacggcgcgtgcatcgaaagcaccggcacgcccacgtcgacgacatccacatcaagcgccgcgacgtatttggcgaccgttccgccgccgcctaaatcgacctttccaagctcgccggtctgccagacgacgcccgcgccgtccagcacgcggcgcacctgggccataaattcggcggaggcctggcttgtgccgtatttgccgccggaaccggtgtactgtgttacgacaacgccatagttgatatacgagcagttgcgcttttcaagcgtgtcgccgaacgtcggatcgaacgcggcgttcacatcggcagacagacaggtcgatttggagagcacctcgcggccggaaaggccctgctgcgcagccaggctcttaataaaaaatttcagatagctggagtttagccccgtgttgccgtcggagcctgtttcctccttatctgcaaagaccgtgaccgtcgtataagcgggagccttgacctccattgcggccatcagcgacgtgtaggcgcatacgcggtcatcatggccgtaagcaccgatcatcgagcggtcaaaaccgatgtcccgcgctttaaactgcggcacgacacacagctcggccgacaggaaatcagcctcgacgatgccgtatttctcattgagcaggcggatgatgtttagcttgaccttttcgctcgccttgtcgtccttaaacgggcggcagccgaccagcacattcagctcctcgcccttcagcccgtccttgagcggccgtttcatttgctccgcggccaggtgcggcagaagatcagtcacagtaaacaccggatcgccgtcgtcctcgccgatagcgcaggtgatcgtctcgccgtcctttttcacgatgacgccgtgcagcgccagcgggatcgcgccccactgatattttttgatgccgccgtaatagtgcgttttgaaaaacgcgatctgcgcctcctcatacagcgggttcggcttgaggtccaggcgcggcgaatcgatgtggctagccatgatgcgcacgccgtcggccagcggccgcgtgccgaacgtcgtcaggatcagcgccttgccgcggttgttgtaataaacacggtcgcccggacggtacgcacccttcggatcaaagggcgcatagcccgcctcgcgcgctttttttacaatccaggataccgcttcgcgctccattttgcacgcgtcaaggaacgccttgtacggttcgcagaaatcctgcgcggcctgctcggacgcgtcgtcggccgtcatgccgatattctttctgttgagcagcagcttttcctgcaaaagttcgcccgctgatttttctttttccatcgatcgaatcctccctatctgtccgcggccatacgctagaaatcgtacagcctgcggtaaatttccatagtctttttaaccttcgccacataagcgcgcgtatcgtcgaatgggattgtcgtaaccgtctttccgtccggcgcatacgctgggtcggaaagccaccgcttgacgctgccccatccggcatggtaagcgcacagcgcgttgtcaaccgaaccgaattcatccagcaggatgcgcagcatcgtcgtaccgtattcaatgtttatatccggatcaaagcacgcctccccctgcggggcctcgccgccgcccttgcgcatctgaatccagtcgaacgcatccggcatgagctgcatcagcccctgcgcgccgacatttgatttcgcgcgcggatcaaaaccgctttcggtacgcacaacagcatagaccaacgccgggtccaagcccttttccgcgcacgcccggccgatctgcgcttcgtatttcatcggatacgcgcggtgataatacgccgcaaacccaaagcgcgccgcagcgatcgcccccacggcaaccagcgcgagcagcgccagctcaaaagcgagccggagcgcgcgtctctgttttctgataaccgattcccccgatcattcgtcgccgccggtcagctcctcaaaatcgcccgcgccctgctcgggatcggcgggcggctgcaaaaccggttccccgccgcgcgcacggcgctcaagcttctccatcaggtccataaatgcaaagcgaagcgcgtcttcgtcctcgttattctcaatcacataatcggcgcgtccggtataaaacgcgtcgttgttctgcgcgttgatgcggcgcatggccgcctcctgcgtcatgtggtcgcgcgcgatgatgcgcctcgcgcgcgtttgttcatcggcgatcacagccaccacgcagtcgcagcgtttatcaagccccgattcgtacagcgtcggcgcgtccagcaggagcatccgctcgccgcgcgcgcgcgcctgctctattttatgcgcaatcgcctcaatgatgtaaggatatgtcacttcattgaggcggcgcagctttttgcggtcggaaaaacagatctccgccagcttctcacggttgagcgtcgcgtccggatgaatgacctccgtcgaaagcgccaacaccagatccatcaggcagcttttggaatgctccatcgtatcgcgcgcgacagcgtcggcgttaatcaccgccacgccgcgttcggcaaacatgccgctgagcgtcgatttgcccgcgcccgtctggcccgtcaggccgataatcatggtctttgtgccgtccaccggcttttgcgcccccttttctcagaaaccaataatcaaacgatccacccgtcaggcaaaacatgccgcggggatgtgccaaaataatccgtcgattgctgccaaaggcacggctttgacaaggcccgtttacacccaaagctcctcaaagccagccgcccgcagcagccggttataaaccgcctgcccgacgccgcccgcgccgtccacacgcgcataaacgagcggcacccccgcacggtcgatctgccgcagcgcgtcgaacagcccgtgcgcctgcgaagcggcgtcgtcctgcgcgccgtagacgatgcacgggcacgacagcgcctgttcatcgcccgccaggcagagcgcgccgaaccgcccttcgcgcgacgccaaaaagtccgcgaacggcccgcgcgccgcatgtaccagtacgacgcgcgccttcggcgcgtaatgcttgtacttcatccccggcgacgcggcgcgcacgccgtccggcagccgctcaaagacgccgggccccagctcgatatccgcaagaacctgccgcgccatctccagcgtgaccgcgcccggccgcaaaatctgcggcggctgttcacagagcgtaagcaccgtcgactccaaccccacctcgcacggtccgccgtccacaatcgcatcaacgcggccgtccaggtcgtcgatacagtggcgcgcgcacgtcgggcttggcgaaccggacaggttcgccgacggcgcggccagcgggacgccggcgcgccggatcagcgcccgcgccgccggatgcgccggcatacgcacggcgaccgtatccaggccgcccgtcgtcgcagacggcacaagatcggatttctccaggatcaccgtcatcggacccggccagaaccggtccgccagcctgtacagcgcatccggaacagcctttacaagcggcggcagctcgtcaagcgacgcgatgtgcacaatgagcgggttgtcgcatggacgccccttcgccgtgtaaatcgcggcggccgcggccgggtcaagcgcgttggccgccagcccgtagacggtttcggtcgggatgacgacgagctttcccgcgcgcagcagcgcggcggcggcgtccagcgcggcctcgtcgcgcggcgtcccctctattttgaactgttttgtctgcaaaatcccatctccaatagaactttgggccaggcgggaagctttacgcttcctcggccgatttaagcttttcggcctggtcgaacgtcatcagcgcgtcaaacaattccgcaagatcgccgttgagcacggaatcgagcttatacagtgtcagcccgatccgatggtccgtcacgcggccctgcggataattataggtgcggatacgctcgctgcggtcgcccgtgccgacctgaaggcggcgctccgtagcgatcttgtcgttttgttcgcgcaccttgatgtccaacaggcgggcgcgcagcaccttgagcgcgcggtccttatttttatactggctgcgttcatcctgacattcgacaaccataccggtcggcaggtgcgtcacccggatggccgacgacgtcttattgacatgctggccgcccgcgccgctggaacggaacacatcgatctgcaaatccttcgggtctagctcaaactcgacctccccggcctccggcagaaccgcgaccgtcaccgtcgacgtgtggatacgcccctgcgtctccgtctccggcacacgctggacacggtgcacgccgctttcatatttcaggcgcgaataagcgccctcgcccgtgatggaaaaacagatctccttatagccgccaagctccgtctcgttggcgctgatcgcctcgcactgccagccaagcccttcggcatacatggtgtacatccggtacagcacgccggcaaagagcgccgcttcctcgccgcccgcgccgcctcggatttcaacgatgacgtttttatcatcgttgggatcgcgcggcagcagcaggattttcagttcctgcgccgtctgatcgaggacagcccggttttcgtcaagctgctcctgcgccagctcgcgcatctcccggtcaacgccgctttcatcgagcacctcgcgcgcttcgtcgcacgcgtcctttgccgtgcggtaagcgcggtacttttcgacgatcggcgtcaggcggctgtattccttcatcagcgacgcgtactgctccggatcgccggtcacatccggttccatcaggcggcggctgatctcctcgtagcgcgccgcgacagaatcgagcttatcaaacatattgatttcctcccaagccgcttacagaaaatcctccgccggcagagcgcgcgcttttgcagcctgtccggcagtccggtttctacaggcggcgctttgcaagctggctgcggtcaagttcctgcccgccgcgcaggacacgccggatatttttttccaccttcgcgcgcgcaaccataacctcgcgcccgcagccgttgcagcggatgcgaaaatccattcccacacggccgaccgtaaaccggcattccccgcacgggtgcggctttttcattataagaatatcaccgatctgaatatccatccgcgtccctcccgcctgatttccttaaaggcattctgtccgtttctacaaacggcccttcctcaagatatccattcgatatcaatttattatacaaaatattggaccataacgcaaggatgccgacgcaaatattttgttcagacaattttttcacgaaacggatatttatggagatcaaagcccgccccgacgcagacgcaaagggccggcggcccgccttttcttctcaagccgccttctgtctgtatttgcgcccgccgtaccgcttctatttgaaaaagcatgctcatatagatgatgtatgttgaaagaggaggggcgcgaaaatgccaacttataaaccggagggtatgctgattgataccgtccccaaccggcaggcgttcaaatcgatgacggctcttatggaggcgcaggcctccggccgcattctggaaagccgtgcaatcgtctgtgattccaaccataatttgattgtcgatatgggtgcctggcgcggcatcatcccgcgcgacgaagccgctcttggcatcgccgagggaacgacgcgcgacatcgcaatcatttcacgtgtcaataagcccgtctgctaccgcatcacaggctttgagcacagcggcgaaggcgtcgtcatcccacagctttcgcggcgcgctgtccagcaggaatgtcaggatacctacatatcaaagcttgtgccgggcgatgtcatagacgcgaaggttacgcatttggaatcgtttggctgtttcgttgatatcggctgcggcctgccgtccctgatccccatcgacgcaatctccgtcagccgcatcgcacatccgcgcgaccggttcacacctgcgcaggatatcaaagccgtcgtcaaggcggtcgagccggacgggcgtgtttcgctcacacacaaggagctgcttggaacctggagcgaaaacgcggctctgttttctcccggcgaaactgttgcgggcatcgtccggtcgatcgaggactacggcgtatttgtagagcttgcgccgaacctcgccggactggcggagccgcgcgagggcgtcacagtcggccagcacgcgagcgtctacatcaagagcctgatcccggaaaaaatgaaggcaaagctgatcattgtcgacgccttcgacgccggatggcgcgccgccccgacgccttatttcattacagaaggccatatcagccgttggcagtactctccagcctgttccgaccggctgatcgagacggtattcgatcccgcataaaaaaagcacaggggcgcgggccgcccctgtgcttttttattactttttccacacaatacgtcccaagcatccggccgtgggatacgccggcctctttttcaaaaggccggaaatcagccgccatagctgctgatttcgatagaattgccgtccgggtcacgcagataaaacgactgcatcgcgccgcgcagaccgttgcgcggcacgagcgaatcggagacatcaagcccctgcttttcgaaataatcacgcagcatccgcagctcgtcgatattgccgtccaactcgaagcataggtccgtactgcctggctgcatattgtcagcgtgcggataaacgccgtcgccgcgccggtaaaggtttatgcgcacgtcgccggcggtcagctcataccggccctgcgcgtcccggatggaaaacccaagcatcctgtaaaacttgaggcattcatccacaacgtccgtcgtcatcactacatgatcaatcttcgaaatacgcatcgcaacgtccccttcctgtccgattttcagtccgcgtcaggcatccgtttcacgctccagcttttcgcggtacgcgcgcgcggcctgttcggtcttgttgtctccaaaggtgtagtacgtccgcccgagcagcgtgtccggcagatattgctgccggacaaaatggcccgggaaatcgtgcggatacttgtaaaactgacctggccgcgtgacatccgcgccgtcataatgcttgttttgcagacagcgcggaatcggacctgccagcccggcgcgcacatcggcaagcgcggcgtcaatacctaaataggccgaattagatttcggcgcggtagccagcagcacggccgcctgcgccaatgggatgcgcgcctccggcagaccgagctgcaaggccgaatcgacgcaggctttcacgattaccgctgccatcggataggccaggccgatatcctcgctggcaatcacgagcagacggcggcacggggaaagcaggtcgccggcctccaaaagccgcgcgagataatgcagggccgcattctcatccgatccgcgaatagacttttgcagcgcggaaaggatatcataatgctcatcgccgtcacggtcgtagcgcatggcgcttttctgcgccacctgccgcgcttcctccagtgtgaccgtctgattcgcaccagccgcgagcgcaagcagctcaacggcattgaccgccttgcgcacgtcgccgccgcacgcggacgcaatatattcgcacacgccgtcctcaatttcaaggcgtcggcccgccgcctcgccggcggcctcgaacgcacgctgcacagcgcgctgcacagcctggggctgcaccggcttgaattcaaacaccgtgctgcgcgacagcaccgcgttatatacataaaagtacgggttttccgtcgtcgaggcaatcagcgtgatcgaaccgttttcaataaattccagtagcgtctgctgctgctttttattgaggtactgtatctcgtcgagatataaaatcacgccgccgatgccgtcaatcgtattcgtctcgccgaccacatcgcggatatcggatgtggaggcggtcgtcccgtttagcttgcagagcttctttccagcacgtttggcgatgatcgacgcgacagtcgtcttgccaacgccggacgggccgtaaaaaatcaaattcgggatatttcccgactcaaccatgcggcgcagcaccttgtcccggccgagcagatgctcctgcccgaccacgtcgtcgagcgtctgcggccggatgcggtccgcgagcggcgcggccataagatcacctcgattttattcgtacagcggatatttttcacagagcgcctcaacgcccgcccggatctgatcggccttcgactcgaaatcggtcgccgccagaaagataaattctgcgatccggtccatgtcctcctctgcaaagccgcggcttgtgacggcgggcgtgccgatacgcacgccgcttgtaacaaacggactctgcggatcgtcggggatcgcgttcttgttgacggtgatatacacctcgtcgagcttcttttcaagctccttgccggtgacgccgaaattgcgcagatcaagcagcacgagatggttgtcgctgccgcctgaaacgagcttaaagccgcgctgcgtcaacccctttgctagcgcctggcagttttggataatctgatgctgatacgccttgaaggccggctgcagcgcctcgcccagacagacggccttcgcggcgatgatgtgctcaagcgggccgccctgcgtaccagggaaaatagccttgttaatcttcggagcaagctcctccgtacacaaaatcatgccgccgcgcgggccgcgcagcgtcttgtgcgtggtcgtcgtcacaacgtccgcatacgggaccgggtttggatgctcgccggcagcgaccaggccggcgatgtgcgccatatcgaccatgaaatacgcgccaacttcctttgcgattgcggacagcttctcaaagtcaatcacgcgcggatacgccgacgcgccggcaaccagcagcttcggcctgcattcaagcgcgatcgaacgcaccttgtcataatcgatcacctgtgtgacagaatcgacgccgtagggaacaaatttatagtatttgccggacatattgaccggggagccgtgtgtcagatggccgccgtcggccaggctcatgcccaaaacggtgtcgcccggctcgagcagcgcaaaatagacggccagatttgcctgcgcgccggaatgcggctgcacgttggcgtgcgccgcgccgaacaattttttggcgcgctctatcgcgatattctcaacctgatcgacaaattcacagccgccgtaataccgcttgcccggatagccttccgcatatttgttggtaagcacggaacccatcgctgccaacaccgccgggctgacgatattttccgatgcgatcagttcaatatttctgcgctggcgcgcaagctcccgctgcatggccgccccgacctccgggtcactttccgatacgaatccaatcgtatcaagcatgtcattgaacatagtaacgatccctccattatcaaaatggccatccccgccggcagcgggaacagcgccggacgcttcgcccgccgcatccgcggcggcggccgtccgaaaaggtctgcggctttcccatccgatccaaataaccgcttgcgtgttttcagtatagcatagattgcgcctgtcgcacaagcaccttgcgaaaaaggccggtctttctttttcccggcggatatgctaaactggcagcagtatcccaacaaaggagagattgccttgtccatgttcaaccggccgacgccgcccacctggaggatcttgctctatacggcgctttccatcggcgtgcttttattgcttgggcgtcttgcgccgtatatcctggcttaggggctgtttgaaaaatcggaaataccgtctttttctacaaacagcggtgaatccagcgttaaaaagcctcggaatccgaaaggattcctgtgttttttgccttgtattctcctgctgtctgcgaaaaacccggcaattcctctattttcaaacaagccctaaccgctgttcgaaaaaacagtcggcctgcaaatgcataaaggggcgcggcataaaatatgccgcgcccctttatataaattaggagaaaaaaatgaaaagcaaatttgtgtttgtttaaaaggccggatcatctgaaagccatgcctgtcaaacggggatcaggcggttttttcagcgcctgaggactcctccgctgcaaagcggacccgcgttgtacgggagccgcggtatttgcggctggccttgccgtacgcgatcatgccgctgacaaatgccacgcccgcgcccagtagaatcgaagcaaacagcttctcggcaaatttatttacgaacaggtaaaccgcgacatcgcgcagccagcgaagcatcccaacgtcgcgcgaaatttcgatcataccgcccgcgagaaatgataaagcgatgaatgcggcggcagccacaattacgcctgtacgaaacgtatgattatcattttttctgttcagcatagctgtcgcctcctcaaaaagttacaatctgtaacttttataataatttctacaaataattttacgttttgtattttccttatctatactataccacagaaaatcagaaaatcaagaggaaagcgcgaaatttattaaaatttttttcatatttgtaactggtttgtaattagtttgtttctattttgtaatctctcaattcaagcagtcctcttttgttaccattctgtcatgattcaacgcattttatgcccgcaaaggcaaaaaaagaaccatccggacaaatccggcgctgccttactgcggttcttgccgatttttgacgcgggtcttgacggccccgtcgatctttcctacaataaaaaacatctcatgtcgccggacaggctgttaagccgcctgcatattttattaaagcgcccatctcagggcaatcagccaaaacgaggtgtcacatgtcagaagatataccgctgcgaatcattgcgcatatccacagcgatttccccaccaaatttggtatcccgcgtcaaagcggcctgattcatgagctgaaggcagctgttgtctttgagcctgaatatcgcaatccgaacgcgttgagagggctggaagggtatacccacatctggctgatctggcagttttcagaaaccgcgcgtcagggatggtcgcccaccgtccggccgcctcgtcttggcgggaacacgcgcatgggcgtctttgcgagccgttccccgttccggccaaaccccatcggcctttcatccgtgcgcctcgaacgcattgagctgcaaagccccctcggtcccgtccttcatgtggcgggcgccgatttgatggacaacacccccatctacgatatcaagccgtatctgccctatgtcgattcccatcccgatgccgccggcggttttgccctgcaatcgcacgagggctttttacaggtaaacgtcccgtccgggcttttggagcgcatcccgcccgatcgccgcggcgctctgtttgccgttctggcgcaggatccgcgtccggcctatcaaaacgcgcccagccgcgtttatggaatggaatacgccggttttgaaatccggttcaccgtaagcgggcatacgcttacagtctgcgaaatcaccgccaaatgaggaaaaacgggctgcctgttttatacaggcagcccgtttttgttccaaaaacacatgcgcatttttacgtatcaaacgccgggcaaaagcgccctgaaaatccggcagcgctcaatacgttggattttcaacctcgatcttatccacctcgcggaagggagcgagagtggatatcatcttgaccggagtgtcgtaggcattgcggcagtaatggacttcttccggctcaatgtggattaaatcgccggcggaaagcgtgtggacaaccccgtcgacgacaatatcgatcttgccttccaggataaagaaatcctcctccatcacattatgataatgggcgcggaaatcctgaccaggcataaactgcacgaccgcaaaattcatccgggggcctttcatcagatacttgggaccgctgtccccaaaacggtactcgcggtcattttcattgataataaacatggttgtctctcctttttctgtttgtactctcagtggcgtccatccagccgatactttgcacatagaagatgggatttttctcccgcacctgcggattcaggacagccccggggcaatccacatatttttggtcagcttgcggtcgcacagctccaactgcgcgcgataaacctcccgccatggttcgtacatcttctcataaatctcatgattgccggggtccggctggaaggtgcggtctattttaacgcagcggcgcgccccttcggtaatcgacgggtaaatccccacgccataacctgcaaggatcgcggcgccgagcgcggtcgcttctttgacgaccggcgtcaccacgggtttgcctgtcacatccgccaaaatctggcaccacagcggactctttgaggccccgccggcaaagatcagccggtccggttcgccgccgaccgcatctttaaccagttggatgtggcctttcaccagcatcgccgtgttttcaagaattgcgtggtaaaacgtatagcggttgaatttttccggatccagttcgaagttcgtaaacgtgggggaggcatgtttccagttgataaaattcatcacatcgctaaaacagcacatcatgccatagctgcccgtgggaatcttggcggcctgttcgtccatcagcgcataggggtccctgccggtcctttccccctcctgcttctccagctggcagaagccgtcgcgaaaccaccgcataacaagaccgggtttaaaggccagcgcttcatactgccacaatcctggaactgcatggcagttgacgcgcacacgggcataagggtcggttctgccgctttccgtattaaactcatactgccagaagcttcctccgaacaccacggcctgcccggggtcagaggcacccacgccgattgtcccaagctggcagtcgccgccgccgaccacgaccggcgtccctggcgcaagacccgtctggagcgcgccggactcatttacaacgcccgccaccgttccgctctcaagcacccgcgggaagatgtcgccgcgcaggccgcatctttgggcgatcgaagggtcccaattgcggctctgcaagtcgaacaggcctgttgtggagccgttgctcggttccacggcaagcacgcctgtaagcttatagatcagccagtcgttgaacatccccaccacagcggtcttttcataaatttccggcatcttgtccttgacccacaggatacggggaatcgcgttgagcgcgtagctctggccggactgttggtacagctgcttttccagctccggatttgtactgatcagcctgcccacctcgtcggtgcttcgcgcatccacattggcgcaggcccatatctcgtttccgccctgatcgtaaagcaggattccctctcgcatacatgtggtggaaaccgcagcgatttcgtccggggcaacgcctgtttcatgcaggacatcccggatgcacccgctggcaagcccccagttatgtacccagtcaaaatccatgctgccgggatagcgcgggtcctcgcggtgcgtccactcctgctgtgaacatcctatctgatttccgtccagatcaaaaaccacagcgcggacgctgccggtccctgcatctaccgccatcaggtatttcgccattgtggaaccaactccttttttaaaatattatctttcataaatcaaacggcgcccgaaggcatcacggcgtctcggaggtcttcaacagcatggcggccgtttcctcgtcggtaatcaggatatccaaatatttgcccctgagcgccgcgtggatggcctccgccttgtgccgtccacccgctacgccgatgacattgttcatctttttcagctcctcgagcggagtgctcaaaagcctgttatccaacccgctttcaaccgggtttccatccttatcgataaagtggctgagcaggtcgcccaccgcgcccttcatcgtcagcagcagaacatccgcctgtgtgagaatgctgtttttgatgatggtggcgtcttcgctcatactgccgattcccaccaccgtcatggccgcctccctactcatctgttgaatgcgctgcacagagtcctccttgcggatctcctccaccatttcgggattgcttaaaaaaagtggagacgggatcagatgcagcctcgcgttaaaaatactggactgggcgttgggcaggtaatggttcaccccgcctgtcagcgcgaccacattgatcggtgtttccgccctgcgcgccaaatggttcagaacccgactcaaagtatcaccgtatcccatgttgatgaaataatttttgtccagccggtcgctgatatagatagcggcggcctgcgcaaggctctcgttgagatcgccgacttgtccgttgaccgggacgacccatacgtcctgaaggccgaaacgggtaatcagttccttttccacctgcattctccggtcgctgtcctgccggatatggaagctgatgacgccgtcctgacgcgccttttccaaaagccggatcacccgtaccctgctgatcttcaataatttcgatatattctgctgggtatagttttccatataataataccaggccgctttaatcatcaaggtttcctcataggaaaaatcgccgttcatattgacctcccctcgcccacgtcaaacgaagcgccaaaagcttaacaaaaatttgcttccgataattttgttccacaaaaatagtatagcattcttaattttagatgtcaatccgaagcctattcaaagcacctttagcaaaaatttgtgataacgcacaaatcccaaaattaatccgcaaacaatgtacacaaaaaataataaaaataaagaaatttaggataaaatatttttattatctttaaaatttttgttaaaaatattatgaaattaaaaaatatatgaaaaaagcacagttgacaaccccaccaaaaaatattattctttagataaacaaaagacatggctattaacttttatgtattcctgagggggtaatgatttgacaaagccaacttcacctgacggggataaactgttgtcggtccgaaacatctacaaatcgtttgcctacaacgccgtgctcaaaggaatcagcatggacttggacagaggcgaggtcttggctctgatcggcggcaacggcgccggcaaaagcaccctgatgaaaattatcatgggtatctattcgcacgacagcggcgagatcgtggtgggcggcagggaaatgaccgtgggaaagccctcggaagcgctcgccaacggtgtatacatggtgccgcaggagcctctgctttttcccaatatgaccgtggaggaaaatatcctgattggtttcaaccggccgcagcgggagctgcacaaggagctggtggaaacaatggagagcatcggctggaggctggagcttgatcgaaaggccagcacgctttccattgcggagcagcagcttgtcgaattgcttcggggcctgctgcgtcacgcgcaggtgctcattctggatgaacccaccagcgcgctcacctttaaggaggttgaaagcctttttggctgcgtgcaggatctcaagagcaagggtatcggcattatctacatcacccaccgtctcaacgaggtctttgagattgcgaccaccgtggcgatcatgcgcgacggcgtcgtaaccctctccggccccgtaagcgactttacaaaagacgacctggttaaaggactgcttcctttggacatggcggtccaaaaggtcggcacaggcagctcggttgattactccaagccacctgtgctggagctttcgcatttcagtggatatgggtttaccgatatctctctgaaggtctatccaggcgaaattctcggcgtggccggggtcgtcggcgccggccgcaccgaaatggcgatgaccattttcggcaaggacaaggtgctgggcggcaaggtgctgttggacggaaaggatatcaccggacttaaaaccaaggacgttatgaaggcgggactcaattatgtctcagaggaccggcacgccgatggtctgtttaaaataagctctgtggctgaaaatacgaccagcgcgattctgggcagcctgcggatggggcgtttctttctcaaccgcaaagaggaataccgggtgacgcagcaatatgtggacgatttccgtatcaaggtcaccgggcaggatcagcttgtcggaagcctttcaggcggcaaccagcaaaaagtggtcatcggccgaagcctttccagcaatcccaaactggtcattttggatgaaccgacccgcggcatcgacgccgcggcccgcgcggatgtgtacaacattattcagcagttgagcaaaaaaggtgtctctgttctgctgatttcctctgatatggaagaaatcatagaattgagcgaccgggctgtcgcgatctatcagggccggctcaatggaaagttttccaaagaggagattacacaggataacctgaccagcgcgtcctttggtctgtccgggaaggaggcaaatgtatgaatctgctgaaaaaggctttaaaggcgagagaggcaacgagcgcattattcctggtggctttatttgtgattgtcagcctgctcaatccctcgtttgcttcctcggaaaatatcgccgctgtgttcaactccgcggtggtttatatcctgatcgcggttggcatggcctttgcgatcatcgtcggtgaaattgatgtttccgtgggttcctgccttggctttgtagccacagttgtgggcagcctgctgcgggacggctgtaactggccgctcgctttcgcggtgggaattctgatcggcgctgcggtggggctgatcaacggatggggcgtcgcagtgatgggagttccatccctgatctttactttgggcgtcaacggtgttctgcgcggcgccatgtatatttactcaggcggcgcctgggtggaaaatctacccaaagcgtttaaggatttttcctcggcgactttggctggacggctcaccgtctatttttgctgcgctttcctgttggtcgtcgctgtccatctgcttttgacgcgcaccaaaaaggggcgttacttcaccgccgtaggcgacaacgccggcggcgcgacccttgtgggtatttctcccgtgcgtaccaaggtgatcgcctatgtcatctgcggcatcatggcggcgattgcgggaattatcttttgcagccgcatcggatttgttacgtctacaagtggaaacggatatgagatgaaagccgtagcggcctgtgtgctgggcggcatcagcctgaccggcggcgttggcagcgtgcttggcgcggcaatcggcgcggtcatcatgagttccatcagctatctgctggtattcatgggattttcctcaaattatgacaatgccattactggcgtcatcctgatttcgatcgttgtattcgacgcggtcatccagcatcgcgcctcagtccggagccgtcatcagcggctggcagccagaaccggcctcaaggaaggagggcttgcagaatgagcaaaatgaaaagcggtcattccaaaggccttaaatcgttgttgcgtaactggaactcctttctgctgctgttccttgttttggaatttgtcatttttggcgcggccaattccaagttcctgcggataccgctgctgctctcaagcgtcaatgacttcatcgcgatctgtttgatcagcctgtttgtcacattcgttatgattaccggcggcatcgatattcaggcgggcgcgatcgtcggcctgacctcgatcaccatcggtgtggcatggcaggactttggcctgaatatctgggcggctgtactggtggccattgccgccgcggctctctgcggcgcgctttccggctttttcatcgcctattgccgcgtacaggccatggtggtcacgttgggcggtagtttcctgtatgccggtgtggcgctgctgatctcgacgctcagctccaccgagagctatcagggtatcagcgggttccccgacagcttcaaggctttaactaagttcaaattgtttggcgtaatcccctcgcagcttctgatcttcgcagccatgacattgatcgcctatctgctgcttcacaaaagcaaatatggacgcaaggtcttcctggtgggtgtgaatcaaaacgcggcggagttttccggtatcaattccagacttatcattctgtccacatacgtactcagcgccatcagcgcggcggtagccggcatcgtgctgacttcctatctcggtactgcaaagagtgatttaggcagcaccctgacaatgaacatcatcaccgcctgcgtgctgggcggcacgctctccactggcggcaagggcagcgccatcggtacggctctggccgcgctcatcatcggccttcttcgtttcggtctgccgctgtgctttggggtgagcacgcaatacctggacattcccatcggggttctgctgattgtcgtggtcgttggacgcgccatggcgcagcagccaaaagtcgtcagctttatggcccggttaaaacagaattttccaggcgtcaggcagggagcaaaatgagtttgggtaattagagaagccgcattctccccttcttctctaatatataaaattcaggaggtaagtaaacatgaaaaagaccatagcatttcttgcggccgtttcgatggtaatgtctctggctgcatgcggcggaagcgctccggcagcgaattccgaggcggccgccagtccagcggccggagccagcactgctagcactgccagcgccgccagcccggagacaagcagcgccgcgggagaatcctctgccgctgaaggcgccgccgtctcggttgagggaaagaccgtcgcgtttatcccgaagctgaccggcaacgctttctttgaggccgcgaacgaaggcgctcagaagtatgccgccgactggggcatcacggtcgattacaccggcagcgccaacgccgcggtagcggatcaggtgcaggtcatcaacaccgctgttgcttccggcgctgatgcaatctgcatctccacggtcgacgcggccggtgtttccgacgccctgaaggccgctaccgaggccggcgtggcggttgtcacctgggactccgacgcacagcctgccgaccgtactctgatggtttcccagggtacccccgaggttctgggccgtatgctcatcgatatggcctgcgcaggtctggagcagcgcggcatcgatccgaagaacgacgaggtcacttactgctggcactattcccaggcgactgtcaccgatcagaacagctggcaggtagccggcgaggcaatcattaaagaagaatatcccaactggaccaacgtagcccccgacaactattattccgagcaggacgctgagaaagcgatcaccatcggcgaggctgttctggctgcacatcctgacatcgacgtcatcatctgcaacgactccacagctctgcccggacagctccaggccgccgagaacaagggctacaatcaggacaacatcaccatcaccggttttgccagcccgaatgcgatcaaggaatattgcagcaacggcaccctttacaattggggcctgtgggactgcggcgttcagggcgccatgggctgctatctggccgcttacatggcggcgggcaataccgttaaggtcggcgatgtgatcagcatccccggaatcggcgactgtgaagttctcgccaatgaaagcatcgcggaaggcgccgccaccgccgagacgaacaacggcgtcgtgctccttcctgaaaccagcgtttataccgctgaaaacatgaacgactacaacttctgattttttctttctccacaaacaggcgtgcggagcaccccttcggggctgtgctccgcccctgtgaggctgccgcgggcgcggcagcctcacaggggcggagcaaaaaatgctttgccggcggattcatttatatagtcaaattcataaaatctaaaggaggacatatattatggcagatctggaaggcgtaaaagtcgcaaaaacataccatacggacataccctttgccaaccaaaacggtttttacttaaagggctgcaacagcttggattggggcatgaagcgccatatggccaatattttcaatccaaagagcggcaacacagtaatgttcgcatttgaccacggatattttatggggagcacgtcgggcctggagcgtctggacctgcttcttcccaagctggcgccctatgtggactgcttcatgggcacacgcggcgcaatccgcacatgcgtcccccccgagctgaccaatgcgatcgctctgcgcgtatcctccggctccagcatgcttcaggatgatctgagctttgaaacggtagccgtggacatcgaggacgccatccgcatgaattccgattgtatggccgttcagaccttcatcggggcggacggccagctctccagcatcgataatctgagccaggtcgtcaatgccggtatgcgctacagcatccccacgctcggcgtctgcgccgtgggcaaaaacatggaacgtaccgaccgcttcttcaaactggcaacacgcatcatcgcggagatgggcgtccagattgtcaaaacctataactgtgaaaattttgaggaagtcgtggccgcatgtcctgtcccgattgtggtcgcgggcggcaaaaagctttcggaacccgacgcgctcaatctcgcatacgatgttatgcgcaagggcgcgcacggcgtcgatatgggccgcaatatcttccagagcacacatcctgtcgaaatggcgcaggcagtcggcaaaattgtccatgagggctataccgacaaacaggcgtatgagttctatcaggatatgatcaacggctaagagaacaatcatggtggacagagaaactggctgcggttttgcgccgccggaatcatctttgtccaccttctttttttgtgagggggaatctgctttgttcctgcgcgtactggaaatggtgctcccggtcttaattctgcttctgctgggctgctggtgccgcttcaggcagatttttgatcaggggggcctgatgggactgaaatctgtcatcagcaatatcgcattgccggttgtgctgttcaacgctttttttacagcgaaatacagtctgaccgtcgccatgctgtttgtagcggtgtatattgggttttgcctgacgatggccgcgggcttcgggctgcgccggctggccgcgccctatggaaaatttatgccctttctgttgtccggcgccgagggcggtatgttgggatacgccctttacgggctgctgaccggcgaacagtccggtttcgcggccgtagatcttggacagaccgtctttgcctataccgcttttctggcggtgttgaaatcgaccggcggccagacattgtccgcaaggatgatgctgcgcaacatggtcacgaaccgatgctttgtgggaatgctgctgggtatcatccttggggtggccggtttgggaacctttgtcgccggcagtccggtcagcggtattgtctttggaagtatcagtgcgatcacggcgcctaccagcgcgctggtgctccttgtggtgggatacgagctgaacctgaaaaagagccttttgaagccggtggcgatcactgtactcagccgtctgattttgatggggattcttcttgtaatgatcagcatgctgatcttcagcattgttccctatgacaaaaacctgcatctggccttaatggtgctttacgctttgcctgcccctttcatcattcccctgttttcggatgttggaaaggatggcgaatatatctccaccacgctctctctgcataccttgtgcacgatgctgctgtttgtggcaatcgcagcctatgcggttgcctgacggcgcatactgaaaaaaggacttggaaccgaccagttccaagtccttttttgctcatatcaaccatttttccgggccgacagcgccgccatcatagccagcgcaaaaagtatctggaatgccggatacagcgccatgcctccaaagtcggcaacccacccaaacgcaatcggtatcagcagtgtggcaatttgcgaaccgcccatcaataggctgaccgcgctgcccgtgtccgcgtttccaaagacatgggggacatagtgtataaaactggggaaaataggagcacatccaaaccccaggacagccatggataccagcgccgccgcttctcccgaaaagaggagcagcgtcagcccgcccgcggtaatcagggcctggccgattcgcatcattctccggtcgcccatcctgtcggatataaaaccgctcataaacctgcccaatgccatcccgaggaacaggcaggtcgtccccaatgcgccggcgctgtccggcagccccttttgaagcgttatgtagctgcccgcccagagagccgatgtcgtttcaatcgccgtatagcaaaacagcgccgcaagcatcgcaggcatacctttcaggcggatcgcctcccgcatgggctttcttttcgtccccatggaactgaccttggcggatgggatttcccgccaccgggcgcgggaggataaaaacagcagcagcgcaccgaactggaggaccgtcaggacgaaatagcctgcgttccatccggcgcccctgttcaggcaaattcccatgatatatggtcccgccgtggcgccgaggctccacaccatattgagccagtttgcatatttggcccgtagatgcagcgccgaaaaggtgttgattgcgcaaaggaacaaatcctccccaatcccaagcgggatgctgcttaggcagagcactgcgtaagatccgcaattggcatacccaaaaagtccaaggcagatcagcccaaacccgcaggcagcgacccgatacgtcccatatctgccgaccagccggtcggtataaatgctggcggtcacccgcccggcggctatgatcatattgatatagccaaccaaggaaagcgcgacgccaaaatccctgtagacaatcggccagacagaacccagcaccgagtattgcagccccgaagcggcaaatgtgacaaacagtacgaccagaaaataaaacgacatctcggctcactttcaaactgcgatttgatgttcacgcgccattttaaaaacctatattcacagccggagaaagccgggcaggcaaaagccccatctgaacggcgcttgacagctgtgaatacaggttctgaatggattgcgaacttgttgtccccagcgactctatcaaatagggggcatgtttttcaaaggttaagcggaagcgtcccgaaaatccgcatttgttcttttacagccgccttacacgcgtcatgcgcggcgttgatcagctcgatatagtggatttttccgttaaacgcccgcagcttttcatcgatcgcgccggacgccgcgagagaaaggccggtgaaaaagttgatcttgttgatgccgtggtcaattgccgcgcggaactctggctctggaagccccgaccccccgtgcaggacgagggggatttttacaagctccctgatccggtccagccggtccgtgtcgatcttcggcgtccccttgaaaagcccgtgtactgtcccaacggcaacagccagggcatccacgcccgtctcctcaacaaattttttcgcgtcctcaggtttggtataggccgaagcgtccacatcgctggcctccagttccccgccttcggggcttcccacatgtccgatttcagcttcaacgctcacgttgcagctatgggcgatccgaacaagctccttagtaatggagatattttcttccatcgaaagcgccgaaccgtcgaacatgatcgatgtacatccgccatggatggccttgacgcagcacgcaaagctgttgccgtgatccaaatgcaggcacaccgggaccacagccctttgacagcggtccaaaagcctgttgaagtaaaagcttaacttgcgttcgtccctgttgtcggcaaaaaaattggggatcatcaaaataacgggcagcccctcctcctcagccgcggcgacaatcgcctccgtaaagttgtcgtccagcgtgtcgaacgcgccgactgcatacttcttctccacgctttcctttaaaatttctgttaatgttacaagccccatttcatgaacctcctgtcatttcacaaatatgcgtcgctgtaatacatccaatcgtgctccactgttcactttctctcgttgaaggcgtacctgaacacgatcgatttaagctgcgtcacctcgtccatgaccctggagagggattcgcggctgttgccgctcattttcctgccgccgccgaacggcagctccgccgcccggaaattgcccgaaccgttgatcgcaatatggccggttttcagccgcctggcaacctggatgcatgtatagatattgcgggaaaaaagcccgccgccaagcccgaaatgcgaactgttggcgatttcaaccgcctcgtcgaccgtatcgaacccgatcacaggccacacgggtccgaacacctccatgtcgcgcgcgatatccatgtccggcgtcacatcggcaaggattgtcggctcgtaaaacgcgccgctgcgcttgccgccgcgcacaatcctggcgccctgcgcgaccgtcagctccacctgcttttccacctgctttgcggccctttccgcgatcattggtcccatattgaccgccgggtccatcggatcgccgatcacaagcttatccaattcggcgccaagcctcctgatgaattcccccttcaggctgttatgtaccaaaaaccgcttggaacccgtgcagcattggcgattgttccgcgcctggtcttcggcctctttgatcaccaggtccatgtcagcgtcctcaaacacgataaacgggtcgttgccgccaagctcgaacttgtaatcggtcagatgcttggccgccgtcgccgcgatgctcagtcctgcgtccgtgcttccggtgaagttgacgcatgcgatccgcgggtcatcgacaagcaggtcgcccacaacagagcctctgccggtcaggcactgcgccgcgccggcgggaagcccggcctcatggagcatctcatggagtacaagaagcgtcatcggatcatacgaaggcgctttgaccacgatcgtattgcccgcagcaagcgccgccgccgtcttaaacgcccagattgccggcgggaaattataagggatgatgcaggcgagcgtcccgagcggttcatggatcgtaatctggagatcgtcgtcatatcccggctccgtaccgatcggcatggtcgtcccatagtagtggagcgcgacgtcgcacgcgccgcggtatacatacgctacggaatcaagctcccacacagcttctttcatatacggcttgcccgcttcttttgccaggatctcgcccagctcaagccgcctttccatcaccagatcggcgaatctgcgcaggatggcgcaccgctcccgcaccggaagcgcggcccaggcctcctgcgaggcgaccgccccatccaccgcctttgtaatatcctccgccgtggcggaaggcaccgtatcgatcacctgcaacgttgcagggttgacgatgtcctgtgtctttccatcggaggaatctaccttttgaccattgataatcattttcataaccgtcgtctccttttattttctgtgggcgtccagataatcctgtacctgctgcctgctcttaattgcaccgctcgccccatattggctgattgcgatcgccgacgcggccgacccgaagtacagcgcctcctcgatggagcgcccctccacaatacctgtgatgaaccccgccacaaagttatccccagcccccagggtatcgaccacccggtcggcgattgtgccgacgcggtacgtccggccctgcgcgcttgcaaacacgccttcagcgcccattttcagcacgaccgtccccacgccccgcctgtggaacgcctgcgcaatctcctcgggtgtttgtttgcccgtaaagtaagccgcttcatgataactggggacgaggagatccaaatacttcatcgcgcccgcgatatcctccagggacatctgcgactgatccagaaccatatcggccatcgtcagcgccccggcttcctttgcctttgacaacagctgcgtcaaatcagcgtcggtctggcccctgctccagaaaaggcttgcgatggaaacaagttttgcgcccgaaaagtcgatgtcgaacacctcggtgctgtaacgcatattgcccgccgcgccgtttttaagggtcatgcatccatgctcgccgtcggcccccacggtgacaaccgtcgccgtcgtgccgtgctcccggtccctgacaataccgtccgccgcaatcccgaagcttttgatcaggctcatgaaggcgctgcccagcgcatcgtcgccaatcaccgtgtagagccttacatcgtttcccatcgcggccaggccgaccgcctcgttaacggcatcgccgcccgcgaacaggtcgatgctttcagaaaactgcgtcatgccatcaggcgtcctgtccgggccgttttttacaatgatgtcgacaaccgcgttgccgacgcaaatgactttattcatgaggcgctttccccttgctgcaatcaaattgacgagacatccccgcgcccggccggccccttgcatccctgcgcgccggccgggcggcggaccgcctgtttttttatgtatcagtcgtcgctgattttgagcacggccttgaccatcgactggcgtttgttgacgcagtcctcaaacgcctgcatcgcgtcgtcaagcggataaaccttggatacgatgtcctttacattgatccggccggccgcgatcgcttcgacgcatgtaggatagatattgagatagcggaagttggtcataaacgtaagctctttgtcgcacatcttctgcaaattgagcgacgtctcgccgaccacgttgccaacctgcataatcacgccgccctttttgcagatataaaccgccgcttcggccgtatggcggctgcccgctgtttcaaatacgaaatccgggccgatcccatcgcaatacttgagcacctcggcgacggtatccttgtcggctgtgttgatcgcgcgcgtcgcgccgacctcgagggccttttccaaccggatgtcatagagatcaacggctgtgatatccgtaattccggccgctttgagagacatgatcgtgacaagcccgatgcagcccgttccaagcacgaccgccgaatcccccacatggatgcccgaacgaacaaccgcgttcataccgaccgcaagcggctccaccagcgcgccctccatcgtcgacacatggtcgggaagcttaaagcaaagctccgccgggtgtgtgatatactcccgcatcgcgccgcgcacgggaggcgcggagaggaattccatgtttttgcagagattgtaccggcccttcctgcaccattcgcatttgccgcagaaggtccccggctccacgcagacgcggtcgccgaccttgaggtccctgacatcgccggccacttcgaccacggtccccgcaaactcatggccgatgataaacggatagcactggggccagaaatccggttccagattgaggaaatgatgcacatccgagccgcaaacgccgcagtaccccaccttgaccttcacataaccgggcttcatttccggcattggggaatccatgatttcaatttttcttttctccatgacaaacgcagctttgttgaccataacaccgcctctttcattaattatttattataaatataataataattataatatcattatctataactatatcaaagaaagataaaaagtcaatataaagaaaaaataatttaaatttgtattgattttttataaaaacgctgttatattaatgatgaaataataattattttaattattattaattaaataataatcttgttttgcagacattttttataggtaaatgcgaatctcaacaggaacgccattttatagctccaaagcatgtaaacccgtatatcaacgacagaaagggagatcaataccatgaaaatgctgatcagcggaagctgggtggatgccgccgacggcgcaaccatcaacgttacaaacccctgcaacggcaagctgctcgacacagttcccaacgccgccaaggaggacatcgaccgggccatcgccgacgctgcggccgcgcaaaagctgtggaatcgggtcatcatccgcgagcgcgcgaaaatcctgcgcagatatctcaaacttctgacagagcaccgggacgatctcgccaaaacgctcacgctcgaaactggaaagccgattttcgattcatacggcgaaattgattccgtatacatgaccttcgaaagctccatcgagatcgtaaagcatcactacggaaagtccatgcccatgggcatcgaaggcggttacgacgacgacctccaggtgacagtacacgaaccgctcggcgtgatcgcctgcatcgttcccttcaattttccggcagctctttgggcgttcaaggcagggccggcgctgatggcgggcaacgccattgtcgtaaagcccgctacctccaacccgctcaccgttttaaaacttatggggcttctggttgaggcaggcgttacgccgggtgcggcgcagtgtgtcacaggccgcggttcgactgtcggtaactggatctccgacaatcccgctgtcgcccaggtcaacctgacgggcggcgtggaggccggcaaggagatcgcccggcacgccgccgagcatctgaccgcttacaaatttgagcttggcggcaacgatcccctcatcatctgcgcggactgcgatatggatctggcagtcaacgaggcgggcgacaagacaagaaatgcgggccagtgctgttccggcgccaaaagatttatcgtccacgaatcgatcaaggacgaatttgtaacgcggctgatcgaggaacgtctgaaaaccgtcaaggaaggagaccttcttgatctcgacaccaatttcggcgtcctgatcagcgaggaggccgccaaggaggtcgatcagcaggtccggcacaccgtcgatcagggcgccaggctggtatacggcggcgtcaggaaaggggcctattatatgcccaccgtgcttgattgctgcacacgggaaatggatatctgcaagaacatggaaatctttggccccgtcttcccgattttcaccttcaaaacgctggacgaagcgattgagatcgcggaaacgtccgactacggccttagttccggcgtcatcaccaacaaccttcaggacgccatgaaggtagccgcgagcctaaaaacgggcatggtggccatcaatggctccggcggattccgcgcgcaggagctgcccttcggcggcggaaagaaaatgagcggcaacagccgtgaatgcatgtcgtccgttttggaggaagtgacacaggaaaaatccattattttcaggtatgccatgaagaaatacaacgatgcttgatcgcccatcgcgcgatcatatccgccccggggaggagaggaaatgaaagctttatattacgaaaagccgctcagggaaaacgcgtctgtccgggagatgccaaatcccgtgtgccaaagccatgacattatcatcaaggtgatgagctgcagcatctgccacggcgtcgaggcggatcacgagacccctggcggcagcggctgttccagctatccgctgatcccgggccatgagttcgccgggtatgtccatgaggtcggggacgctgtcacgaccttccgcgtgggcgaccgggtcacggctgacaacaccgtcacctgcggcgtttgccattactgcaagaagggcgatttgatccactgcccggacaaaatgaatctggggaacaaagccagcggcggcttcgcggaatatgtaaaggtttccgaacataaagccgtccggctgccggatcatgtcagcttcaacgaaggctgcctttccgagccggtcgcctgctgtattcattccatggatcagatggatatccggtatggcgacgatgtactcgttatgggcgccggtccgatggggatgatcctggccatgctggctatgcacagccatgcaaaccgcgtcgttgtctgcgcaccgtctgcggcaaagctggaaaaggtcaaagcacttgggattgaaaccgttttgatggaccgcggcgactactccaggcatgaagccgaactgctctcccgctatccgctcggcttcgactgcctctttgacactacaggcgccgaggaacttgtctactccacgcccaaactgatgaagatgggcgggaaaatcctgggctatggctattaccgcggcatgcatccgacgctgcgtttcccatttaacgaattttgggataaggagcttacttattactcctcactcagccaggtcggcgattttgaaagggcggtagacgcaatcgccacaggcaaggtcaatgcgaaggccctgatcagcggcgaatacgatctggaccattactttgacggccttgaccgggtgatgcgcgaaaaggacgtgatcaagatcatcatccatccgaacgccgaaccaggcgcgctttaaaatatccgtccgcggcagagtgagctttcgatgcatgtggaacaaacacgggcgcggcggccgcgcccgtgtttattttgtccgcgcgcctaatacccggccagcgttaagcgaggcaaatcgtcctgccctgccgggccgattcatacatcgcctcgatcacccgcacaacggcggccgcctgttcggcacggaccacatgcggccggccgccctccaggtcctccagccaactgtccatctccatgagcggcgcgcggccaaccccgttttttcgccccatccaaagcggcggatccggcccgtcgggcacgaccgaaactagccggccgtgcatcgccttcaccagcctccattgataggagtccggcgtgtcgccgggcagctgctgcgccccgcctttggtcccgcacacggttacgcacgcctcccgcgcgtcggggatattgagcgcccaggcggcctccaccgtgaggagcgcgccgtttttcatacggataaagccgaacgccgaatcctccacctcaaaccgggacggttcccacggcccccacagattcccggccggatcgtcgattaagcccctgaacgccgccgctgtaaccgattcgaattcataattgtccataaaccacagggcgagatcgatggaatgcgtaccgatatcaatgagcgggccgcctccctgcgccttcagggaaagaaagctgccccatgtcggcacctttttcctgcgcgtggcgtgcgctttcgcataatagatttcacccagatcccccgcgagaacagcagcatggatcgcctgtgaatcgcttctgaaacggttttgatagctgacggagagcttccgttgatttttttcagcggcttttaccatcctgcacgcgtccgcatacgtttccgccatgggcttttcacacatgacatgcttgcccgcctcaagcgcctctaccgcaatcttgcaatgcgaatggttcggcgtacagatatgcacggcatcaaccgcgggatcctccaaaagcgcctcatatccctcacaaaccgccgcgccgggcagccgctccctttgcaggctgtgtgccgccgcgggctgcgcgtccgccagggcgacgatctcgcagcggtcgggaaattgcagcaaagcgtccacatgcttttccctggcgatcgcgccgcagccgataatcccaattttcaatttccccataagccgtcttcccttctccgccctattccatggcaagcaaaccgccgtcaaccggcgtggcgacgcccatcatgcagccggcagccttcgacgccagtgccgcttgacacgcttttcttctttcatcggatgtggaaagatctccgatgacacagcggatcacgcagcccgtttcctgcgtcagcagtatcctccagactctttgccagatcgatcaggcacaccccggcgccgcagcaggcaaaacacctcgtgccctccctgtccatcccctggcgggctccggtcacgatatccttttggccggtcaaatcgaacagattgaggctgtctttcacaccgattccaccttcagtacaaaatagggctatccaaaggtcctgcggagcatggccgtgtcccttgcaagcagttcctcctgcgaaccccggccgcatacggacgccttgtcatagacgctttcaataatcagggggcctgtataatcgctatcaaggatggcccgcgccgttttgaaaaacccggaggtcccctcccccaacagcgaaccggagagcatcggaccgacgccgtccttcagatggacgccgccgatcagcccggacagttcggtgaaataccgtgccatcgacgttccatcatagacatacaggttttgggaatcaaaaaagagcttcaccttcggattatccacagcatccagaagatcgtaaacctgctttacgctccgattgatttcaagatgggtttcaatgcccaggtccgcggctttttcactgaaccttttgatataggccgccgcacggtggaaggacgggccgtcacagattccattccgtcccaacaccggcagcaaaaacgatttgcagccaaataccgtgcaaagcttgatcgtgcggtcgaccagctcggccgcgatctgttcctcctgtgcaccctgcggcattgtaaagctgtactgatccacaaactgaggggacagggaacagatttccatcccgtagtccgcgcttgcctgcatgtattcctcgatcacggcgcggcagccaagccctttaccctccagcgcctcctcgccgaccccgagctgcaaacagtcaagcccttgctttgaggcgatcctgcaaagttctttcccccgcgccttcagggaccattcacacacgccgtattgaaatctgcccataacgactcctttcatctgcccgcagcttcacggaacagttttaaataccattctgtgattggatacggcttttccagtgccgcaaaagcagcgtccggcgtaatcgtggcgatatctgcgccgattgcggctgccgcagccagatcctgcgcacgctccacagccgccgcaaggactctggtatgcgttcctttcaaagcggcaacgattgtccgcagcatatccatgccgttatagccgatctgcccgatatctccgatgtatggagcgacatagtcggcgcccgctgcagacgcaagtattgcctgcgccgcagtcatcaccgtggtgatgcagatttcgttatcaaacaggcgttccatgcggattgtgcgcagcgcccgcagaccttccgcacaggctggtattttgacaaccacctgcgggctgatcgccgcgcaggccgcggcatcctttacaatttcgccgcatgtttccgcgttggtctgcgcaaacaccggaaacccgggaaactccctgcaaatatccgcgatcacttcggccggcggcgccggctctcgggccagaatagctggatttgtcgtaattccgctaagaattcccagcgcttccatcctgtggagcagttcaatattcgcacagtccgcataaaaaagcattatattttccctcctgtgtaatgatccagcttcttgacaagctcgcgggaaaggtccctgagatcccaaatcggcaggcattccccgattttctgaatctcctcaagctcgcgaaaaacgtccggcgcaagcggtcccctgccggcagattcgatattctgccggatatgggcgatctcccgcgcgcccgcgacatgcgtggcgatctcctcatgattgatgatatagcggattgtcagctccggcagggacagccccgtttcatcagacagacgatagatgcgctccagcttcctgacaacgttttgaacccgctcgtcctcaagcggcctgagcagttcaagccaccttctgtcctttgcaatcaaaaacgggttgttctgcccgaacccgcctccgagagcgatacccacaccgtgctgtacgcacgcggggatcaactcatcatagatgggctttgaaagcaagctcatcccgccggccggaagtacaaaatcgaacttacccgattttacaagctgcgcaagaccatggtaatcccatccacccaggccgatgcttctgaccagcccctcctttttggtttcgaggaggaaatcaatcgccgcgccgcgtgcatgttcataatcgatttgccactggggccagtcaggctcatggatactgaaaatatcgattacatccttttgcagaagccacatgctatgtttgagcgcccgcatcatttttacagggtctacaaaagcctttgcatctgtctgccgcaccgtattggcgtacacctccctgacggtcccttcaaagtaccccattttcgttgaaaagcgaagcctgcggttgtcacggtggcgcgcgagcgcccggccgagcagctcctcgctctccccccatccgtacatttgagcagtatcataataggtaattccatgatccatggcataatccagaatcgcattagccgtatcctgcatcacatggaattcttccgtaaactggtagcatcccaggccgagaacagagacatccagtcctgttttccccaatcttcgttcaagcatcgtgtccacactcctgtctgttccaagccgcaaccgtgcgccattctccagccctgcggccgggtcaggcaggctccccatcgtataaatcggcaagtgccttttcgagtttgtcataatcctctgttttcagcggctggaacggtttgatacagttgccgcagtcgatcccctgcagcttgagcacacccttgatcgcagggaaaatccctatttcaagcagcgtttcgagcatcgcgttggccttgccctgaagataccgcgcacgctccatatccttcgcatcaaatgccctcatgagctgaacaaagatgtcgcccataatcgaaaatgtgctgccgatcgaagctttgacgccgatcgaaagcgccgggagcaggatttcgtcatgcccattaaatacagccttgtccccgcatgtcctgaccagcgtctccgtctgcataagatccatggtcgtctgcttgacgccggcgatcccctcatgtgccagcagctcgatcaattcctctgttttgaaggagacgccgctcattttaggaatgttatagataatcaccggaagtccggcaacctttgcaatatcaaaataatactgtacaatctcctgcttggaataggggaaataaaacggcgggaccgcggagacagccgtcgcgccgcttttggcggcgacatgcgccagctctatgctgcctttggtcgaaaaagcgccgatattcgcaatgacatcgcgtctgccgcccacaatttcacaaacagccctgatcaactgcgctctctgctcatcacgcagcagaaaggattcgcctgtgctgccgctcacataaaaccccgccacgccctgcgcaatggatctttcaatcacctgcgccagcgccttttcgttgatctgttccttttcatcgatcggggtgatgatcgctggataaatcccctcaaaccgtttcatattccgtcctccttttatccgtccatttcaggcatcaggacaaccttcgccgcctctcggttcgcaaactgctcgaagccctccctccatttggaaaggggcagcttgtgggtcacgatcgggtccatatcgacgcgcccttcacggtacagcgccaggacgttccgccaggaagtgtgatcatatcccatatgcccaatgaaggcgatgcctttatgccccatcaaatccgcggggtcctccgcatacgataccgctgtccgggtgtagcccaccatgacgaacgtcccgcccgggcgcagcatctccactgcttgcggcaggatgttggcggagcgcgacgcgcagttgatgacggccgctattccatcctccccgcccagtttttttacctttttcaccagctccggatcgtcggccatcaaaatgtccgtggcgcccagcttctcacagatcgggttgcgcgtgagcgcgcttttcctggtgccgatcacaatgatcccggccgcgttgatcagcctcgccgccagcacgctgaacagccccaacgggccgtttccatagatcaccacgttgtcccccggcaggactttcgcctcctgaacgatggccttgtatgcgttgcaaatcgggtccatgaccgccgcatgctcaaacggcatattgtccggtatccggcggatgctggccgggtccctctgcaatacaattcccggaatccttacatattcggccatgccgccgtccatatccccgccgatgcccttgcgttcggggcaaagcaggaaatttcctgtttcgcacgcgggacagcggccgcacacataaccggtattgtccgacaccacacggtccccaactgtccaatccgcgacatttccgcccgtttcaaagacttcccctgcaaattcatgtccaatgaccattggatacgtgtagcctttgtatttcgcttcatccggcccgtataaaagcggcatatccgagccgcagattccggcagccttcaccttgaggatgatatcgtcgtccccgcataccggctttgggacctccatgtattccagatggaacggcccgtaccctgtttttgccactgctttcattttgttacctcccgtatctccaagtgctgccagcaaaagcagatcgaggaacgcgccgcgttgtttttctggcacacttatcttgcaacacttattattttagattataataatatctgtaaaaattacgaagggtgaatgtcatgagtaaaatcagcactgttaatcaggtaaaagagcacaatatcgccttggttcgtgaggttatccacagttccgttgagtttacaaagcattccatcgcccaggcaacggggctgagcatcgccaccacgaacagcatcctcaatcttctctgcgaagccggagaaattgtagctgtcggaaacgtttcttcaacggtcggccgccccgccgccaaatatgtgtacaaccgggactttgcccacatctgctgtgtgttcccctcctcggccggcagccagcgttacctctcatatacggtttttgacctgctcggcaatcccgtcaagcaaaaccaggtttggctggaggatgtgacctacgagagcttcgaggagctgatcggcatactgatccaaaaggattccagcatcaaaaaggtcagcatcggcatcccaggatattatgacaacaaccatatccattcctgcacaatgacggctttaaacggctgcgatctgacaggcaggctcagcaagcggtttgcctgtgaatttatgatggaaaacaatatgaacgccatcgcatacggcctttatgacgccaggcgggcgcacggccatacccccgccgcccttgtggccgtctccttttttgaaggaagcggtcccggctccgggatcatcatcgatggtaaaatctatctgggcaagagcaatttcgcgggtgaggtcgtattcctcccctatcaggacggcaacatctatgacctagtgaagcagggtcaggaatccattgtcaaaagcaccgcgcaggtggtctgctcgtactgtgcgatcctcaacccggaaacctgcgtcctcaccggcgaaaacctcagcgcggatctgtgccggccgatctttgagcggtgcaaacgctccatccccgagcagcatctgcccgagctgctgtatgtatccaattacaatcaatactatcaaaacgggcttttccgaatcgccctgaacagcccgtaccaccacaggcccagataaagcgcggcgctgtcaactgaaatatcaaaagattccattgacagcgccactgctgcggtgcaaatcacccgacaggggtgctcctactgatttgttcctgattaaagaggctgcttttcacacgcctctgcccctgtgtgggtaccgatcgacgcgcggcccaactggatgaaggcacagaccttcaggacgcttcccgtgcagaattccattttgttcataaaagtttttcatcgtgttccttgatgaaatccatattgagctttagtcccaggccgggaaggtcaggaatggtcataaaaccatggtcaggctttggcgcgtcaaggtaggtgtcggctgtgatcccctcaaacagcttgagccgctccaaaaacggggcgttgccgaacgcgctgaccagatggatatggatgttttccatcgcgtgcggggcgaacttcacattaaacgcctgcgtaagcgcgccgatcttcagcatctccgtaaagccgcccgcgcgtgtcacatccaactgtacgatgtccgcacatccgttgacgagcagatcccttgccccatattttgtatattcctgctcgcctgttgcaagcggaagatccgtggaatttttaaacttgatcagtcccggaatatcgtcggcaaagaccggttcctccaggaacatgatgtcatactccttgacctggtttgcaaaccgcgcgcctgtagccgcatcccaacagttgtttgcatccagcataatcccaatctttggtcctaccgcctcgcgtaccttgcgcacccgcatgaggtcgcggttcgtattgcggccgccttcaacgccgactttaaatttgatattcgtatacccgtctgttttgaccagcccgaccatctcctccacaagctcctcgtccgaataggaggtccagccgccgcttccgtatacgggaattttagtctgttcgcctccaaacagcttataaagcggcatgccgagaattttgcccttgaggtcccacagcgcgatgtcaatcgcggagagcgcgcagaacatcagccccttgcggcccacgccgcgcagatacgccacaagctcgttccagatgacctccgtctcgaacgggtccctgccgatcagcctgggcttgatgtttttttcgatcatcagcttggtggcttcaccgccgacctcgtgataggtgacgccaaatccctcggtcccatcgtccgtaatcacccggacgactgtaaaaccgacggtttcaacctttcttgttgcgtccgcaaagccgcctgcgaccggcctggacacaagatgcactttgatatcgcgaatcctactgttttgcatgtcttttctcccctgtacgatttaaactgcctgtaccgtcctggccttgcggttgcttgcatacgcgtcaagggcgatcgcaaacagcaaaacgccgccgcggacaatgtattggaacgccggatcaagattcatcaggctcatgccgttgtcaagcgcagccatgatcagcgtgccggccactgcgccggccacggtgccgtggccgcctgtaatcgccgtgccgccgacaacgcagcctgtgatcgctgtgaactcgtatccgttgccgccggcggtggtcgccgcgctcaggcgccccacgtagaccagggcagccgtcgcaaccacaaccgcatgcaggacatagagctttaaaagctccttggaaacattgatgccggaaagagacgccgcgtctttattgccgccgatcgcatagacgtatctgccgaatttggtgttgctgctgatataagaaacggcgatcgtcagcacaaacaggatgatcatcgcatatgcaaagcctttatagctgtagaggataaaggtgacaaccgccgcgagaatgacgatcagcgccgttttggggacaatgcgcatccagtttttttcacttaatccctgccgcacgcttttcttttctttcatgactgtaaacgccacataggcgatgatgatcagcgcacccaaaataagcgttgtatcattgcttgtcccactgatcgacggcatgtatccgttgcccatctccgcaatgatcccctcgacagggccgaccatgcgtccgccgcttatgtactgattgacgcccaaaaacacaagctgcgtcgccagggtaatgataaaggccggcagcttcatatagccgacccaaaagccgtgccacaggccggtgataatcgcaatcgcaaaaacgatcaagaccaccacaatcgaagggattgagccatagtttacctggatcagcgccgcgaccatcgcgagcatccccagataacgtccggcggaaaggtccgcgttgcccgtgatgatgacaaggcacatggtaacggaaatgatcgagcatgtcgccccctgcatcagcaggtttgacaggttgcggaccgtcaggaacataccgccggtaaagatctgaaacagcccaaagattataatcgcttccaccaacaggctgtttttataaaacagcgaaaataaatccaattttctttttgctttcgtcatgtcgtaacgcctcctgtcgcagccaaagccacgtcctcctgagttatatttctcgccgaattgtcaaattccgcgctgatcctgccctcgcgcatgacgtagatgcgatcgctcatgccaaggatctccggaagctccgaggaaatcatgatgacggcgatgccttgatccgccatctggttgatcaactgataaatctccgtcttggcgccgatatcgattccgcgggtcgcttcgtccaggatcagcaccttcggctccgtcatgagggccttggccaagcacaccttctgctggttgccgccggacaggttgccgaccctctgcaaaatagagggcgttttgacccgcagcttttttaccatctctttcacttttccatactctttatcccggttgataaagaagccgctattgatatatttgtcaaggctggaaagcgacgcgttataagcaatatccgaagtcaggacaagcccataccgcttgcggtcctccgaggaataaaacacgccggccttaatggcctcattcgaatttttaaagcgcgccctccgcctgcctttatattccatctttcctgtaatagagccttggagcgcgccgaaaatactcatccccaattcggtgcgcccggcgccgatcatgcccgcaaggccgaccacttcgccctcgcggacctcaaggttgatatcgcggacaatccatttattgttgatgccgtcgaaaaccgaccagtccgatactctcagcgccacctccccaattgtgcagcagcgcggttcaaagagggttttcagctcgcggccaaccatgccgctgatcaatgtatcctgggaatactcctccgccggccttgtctccaccgtctggccgtcgcgcaggattgtgacggtgtcggcgatgctcaaaacttccccgagcttgtgagaaatgaagataatgctgatccctttatcccgcaggccgcgcatgaggttcaaaaggttttcggaatcgtcctcgggcagcggcgccgtcggttcatcaaggatcaaaattttacagtttttattcagcgcctttgcgatctctacaagctgctgctgtccaatgcccaaatttcccacaaccgtccggggattgactttgagtttcagctcatcaagcagtttttttgccctttcatattcgaaatcccagtcaataaggccgttttgacagacctcatctcccaaaaatatattttcacatacatttaaggtctggattagaccaagctcctgatggataattgcgacgccggccgcctcgctttccttgatgcctttgaagcggaccttttccccatccaggataagctcgcctgtataatcggtatactcgccgctcaggaccttcataagcgtcgatttgcccgcgccgttttcccccaccagcgcatgaacctccccgcgccggacgccaaacgtaacgccgtccagagctttgacgccgggaaacagttttgtaatgtggttcatttgcaggacataatcctccatgtatgtgcatcctcccttcctttcgtgacgatctgtgggactccgccgctgtgcaggcggagtcccacatttttacggatcagcagcctatttgccgccaacacttaaaaatgctgatcccaccacttttgcagcttgccgcaaatctgttcgggcgtggtgattgtcggatctgtggtccacataacctcgtttccaaaataccccttatagccgttttcatcaaacgttttaaacatcgtctcaagatccagctccccttcccccgggatacggtgttcccaagcccctgaaggaagcaggccgccgtcagtataatggacgttgacgatcttttctgcgccgcagatatcatagacgtcctggacggattccttcgtctgggccaggcacatcaggtcgatggtaacggccatattgtcttttccacagtctccaatcagcttcatgatctgcttatgatccgtgatcacggtgatatccctggtggtcgcctcgtatgtgatggtcacgccttctgttttggcgatttccgcaagcctgctcatcgaatccacagcgatatcccatacatcgccgatactctcatccatgttggcgtagccgggaaacaccaggacatagggcgccccgatggtgccggctgtctggatggccttctcaaaataccggaaggtgcgcaggcgtgtggcgggatttttagaagcaagatttgttggataagcgcaattttccacgttgacttcaaccactctcaagccatgcgcatccagcttatctttaagcaccttcatgtccgcatatgtaatatcatccatgcagaaatgcggctccgctccgtaaaactccagcttgccggctcccagacgctccagggaatccaacgcataatccagggaatagtcaatgtatgggaaattcgactggataaactggtccctcgtcaggtttttaaatttcaccatattactctccatatacttcctcatgagtaaacagcccggccgcaatcaccgtctcgtcgatgttgtccttggtgacgaggacgcccggatagctcatgaacgggatggtctggccgtcgctgttcacgtctgtatcgaaatcctcagccgttttctcgcccaggtagtactggatgacggtttccgtgaacagccgcggatattcgctgccagccttcgccactgtggacacctgtgttccctgaacaatccgctggcatgcaagcaggtcgcagtcctgtccgcaaacgagaaccttgcccgcaagccccgcgctttccagcgcctggatcgcgccgcccgccataccgtcgttcatgcaaaggatcgctgtcaggctgtcgccgtactcggcaatccagttttcagcataacccattgcggtcgcggggtcccagttggtggtccactgctcaccaacaactgtcacatcgcaatttttcatgctgtcaatcatcccttcctggaaccgcacaacgccggtgccgccggtggaatcgccgtaaatatacgcgacgttgcctgtgatgttcatatcgccgatggcttttgtgatcaactggccgatttcaaagaagtcgtttccaccggtgaagtcggcgtaggtatcgcccatgaccggctcatagtagcacaccagaacaccctcgtcgtgggcggccttcatggcgtttgtgatagctcccggttcattgcactgcgcgatcagaatgtcgatgccctgtgcaaccaggttttcaatctgaccggcctgcttctgcgcgtcgttttccgcaacctgataaatcagctccacaccctgttccgcacatacctgtttgatgacatccagctccttgacccaccgttcctcctgctgcgtcttccaggaaacgccgataacaatatcctccttcgctttaacaggttttccgttccagccgaccggcccatccgcaggcgcagccgcgggacttgccgccgctgtcgaaccggcggcaggctccgacgccgcagccgccgcgtcgttggacgcgcaggcgcccagagaaagcagcatgcccgctgccagcgtgatcgcaaaaaaccttttaaacatttttccatcttcctttcaatttttcctgaaataaattccaggtgttttacgccataattataatcacatcgctcaatttattcaataaatttttgatttttttactaatttattttatatttcagccatttcaacaaaccgtttattacgatttcatatatttcacctataaacatctgtaatattgaacttaaacagtgcaaattctatagtattttatttatttttatcagattaagtaatcaatcaattatacaaattaaaaaatttaaatagcttataaataaaaaattgattgacatatatatcaaacattagtataatttattttacaaagattcagcaaaggaactttttcctgtctatgcctggaggtatgcttatgaaagatgcaatatctgtgtcattggcgtcgatcctttggcccgtccatttattcggtgctatcagcgccacccttgcgtcggtgccgtttctatcttttcccgcgacccgcagcggctgctggagcgcgccaagccgcttgggatcgcgccggagcactgctatgccagctttgaaatagttcccatgcctgcgcacccctctatgtgctgaccggtaagctggcggagtccgtcatctgtctcggttccgacgatgtgggccggatctggcgagccgttacggttgtaaggccgtttatcaaacccgccttgttacactcaaaagcagcgatatcaagggcgaaattcatcgcatcataaggacgcaccttccccttgcgcgtcctggcactctgcggatatggatttgtcagcgccattatggagcagcaggattcctatttggatgtgcaggcagccgccaatatcactgcaatcggcatttgtgcggccgcttccgccaaagagaacgaagccaaggtttttatctccgatttttccaatctcgtaagcacagcattcagcacaatcgccataattgattaatacatttattttaattaacaatctttattgattttttacagaaataagttatactaatttgagaggattgtttttgtaaaaatgtgctgttatccaaatctttgttgagaggaacatctatcacatcatgccagatacaatgggatctaacaaattcattaacgatcagattgcagaattgattatggagtgcattgatgagcacaaaaagctccctacggaacaggaattgatggagcgtttccaaatcaaccggtttgcattgcgcgagctgttaaacgcatatgcggtcaatggaattatcgtttcccaacagggcagcggccgctatgctcaatttccggatttgggcatccagatcaaaaatatatgggcgccatttatcaaatgccgcccatccctgctgctggatttttttgaaattcgcaaatgcctggagctttcctctctgcccattgccatgcagaatttaaggccggatgatcttttacaattgcgccgccatacagacgccatgttaaaaaacgccaaggccggcgaatcatttgaagcttatgaccgggactttcactgcactctgttcgcctgtacgggcaacctgtttttcaaacagcttttgaccgccttctgggatatctgcgaggattctattgtttggccttccaacaatgatcttgtatatgtcgctcaacagcatatcgacattttggaagctttggcttgtcaggatgaggcaagggcttccgagcttttaaaccgtcagctcgttgaatcgcgcaatcagattgccctggcattggtgaaaggcgaacagaaaagtccgcacgggcgcagtacttatgtatcagtcaaataaacgaaaaagaagcccgatggattcccatcgggcttctttgcactcgcatatcattttatggctttacctcatacggccttcaaacgatcggcacagagccggatagacaagcagcgccaacatgcctgcgatcattgcagtcacaaactgcggccaagagaacatcactgacaacatctgtacttgctttggcgggatatccggcaatattcccaggagtgcgggaaccgtcagccacaatactgcgcactttgctgccgcgccgagcacaacgcctgcggcacgtattcctgtaccattgaacctcgtaaaaaagaaccaggccgctgccgcaatcacagcattgcccaatgcaatcgcaggcacaatgaaaggtaccggcgtcatgccaagcaaagccgccagaatcgaggaaatcacaccgcacgtcacacccgaccagacgcctgcgcttgccgccgccagaattaacacaagattgaccagggatccggttatcagctgattgaggctgaaaggtccggcaatcaccgccccagcgggcaataatttgccgatcatctgggccaacagtaccagcgcagtacacaaggctgtacgggtaatccatttaattttatgatctgtttttgccatggcagtacctccaatctccgattacaattatacttcatcggtataatttgtcaagagtcggaccctgcggcagcattgatcgtaaaagtatactgtatatagaaagcgcccttttgtttttttaaaaaaacaaaagggcgctttctttgttacatcatggaactgctaaccagatttgaactggtgacctcgtccttaccaacgccgattttcattttttccaatcttttcggaaacacgaaatcagccttttgagtcaaagaggtacaaattccaaccggagctgcttgtccggatccaaaactaccgtctcagattcatctggcatccgggtataacccagccgctctaaagcggcgatcgcccgagctacgtggttgacacccaataccagctttctttgcgggcccattcccagaatatcctccagacacaccgggacaggagtttcttctgctatgggcagggtcaacttcaggatctgaaactgatgaaccatttttactgcttgacggcacaggtccgtaacctggtcaaatctgttctgctctaccagatgccccggacaaatccagcttccaccacaggccagcacattgggcaagcgcagatattgcgccagattttccagacgaatccctcccgtcggcataaaacgcacgccctgatacggagacgccagagctcgcagcatagacgccccgcctgacggctctgcagggaaaaacttaacctcagtcaagccaagttccagagcggcttccagctcggtaggggtggaaatgccgggaaagacgggaatctcccgctcttggcaccatgctaccaccgaccgattcaagccgggactcacaataaaccgcgcaccggcatctacggcttttctcgccatgtccacgctgtatactgtcccggcgcccaccagaacgtccggtacctggtacgccgtttgacgaatggcctccagagcggtgtttgttcgcaatgtgatctccatgctgttcaggccccctgcccggatcgcccgggctagggcagcgcctttctccgcctgtttcaagacaacaacagggaccaggccgctctcaaagaacgcctgcgttactgaatcaggcactttgccgcctccagtccttttggccggccatgaaggcatccagctctgcccggctgggcaggccatcgttgtccccacggctcataacctggatcgcgcccaccgcacacccgcgccggaccgcctggctgaacgtctgcccctctctcagcgcggagagcacgcctgccgcgaagccgtcacccgcgcccacggtgtccaccacgcgctcaacccggaacccgtccacatatccggacgctccattttcgcgggcgtaataagcgcctcttgttccgagtttgaccaccacggcctttgtgccgcggctgatgtagtgcgcagcgattttctccggggcttccacgccgatcaggagcgccgcctccttaatcccaggcagaaagaggtctgaccggtaggcaatcgagttgatgcacgccgccatctcctcctgagacggccacagttgaggccgaaggtttggatcgaaagaaaagaaacacccagcttttctggatttctcgttcagtaccgcggaggcagcgcgagcagatgcggaaagggcaggggtgatgcctgtgagatggatcatatcaaacttggaaaagtccagcgtctccatatccttcgcagccagagtggacgccgcgctgtttctgcgaaaatagcagatcgcgggatctcccgttgtgaccttggatttgaacatgaacccggtcatgtgagtgtcggagtaaaggatctcatccgtggagatcccattgtccctcatggagccgatgatacgcctgccaaacaaatcatcccccagctttgtcaaataagtgacatcatgctctaatcttttcagccctatggcgacattcagctccgctccgcatgtggacagggaaaaactgtttacattttccaaatctcctaccgagtcggccataaacagccccatcggttcgcccacaagcaatacgctttttctcatggttttcctccgtcatgggcacgtttcacctcattcggaccgtagaagctctttcatgaaacacgcacgggagcaggatctcctttgggggctgctccgggttctccaacttttccagcagcagggcggctgcctggctgccgatttgtgtggcggggatcttcacggttgtaatgttcggggacacaataaagggccagttcatctcattggaccagtcccagtcctccgggccgcacaatccaatctcctccgggatagacaatcccagttcctgaatcgcatggaacgcccggaccgtcgtgatgctgttgccgccgatcaccgctggaatcctggatgcgtctcgtccaattgcccgccgcagggcctgcgcggcgctttcccctccgggttccagcgtatacacatctgctgaggcatcatagccgtacagcgtgtgtacaacctccagaaatgcttcccggcgcttcatgcgcaccgcattgttttcccagggttccaccaaaaacagaggatgggtatagccctgctgctttagatggctgagcatctgaaacaagcactcatgctggtcggtcgttacaatgtcgaagttataatcccgcacctgccggtcacacagaacgacaggaagcccgccacaccgcacttgaatcaaaaaatcgttggaatatgaggtcgtattcaccagaacgccggacacaccctttgataacagggaggacagggcatgcttctccttgtccagatcgtctgccgaatcggcgatcagcagggtgtaaccccgcttgtccaaaaatttgcttgctccattgatcagcgcggaggaaaatggagaggagatatcagcgatcagaagcccaatcaaattggtggtacgctttttcaagttgctggcaatatcgctgggacggtaattggtcatctcaatgaccgtccgtatccgctcccaggtcttttcactcatcagctctggatgtccgttgatataacgggaaaccgtagtcttggacactccggctgccattgccacatcgttgatcgtcacgcgcttcttgtcgctcatattgcgctctccccttttcctgcctggcttaaaaaatgatggtgaattgatgtccatttttcattctaatggcttttcaggggaatttcaacccctcaaaggggtaaacttcgtcaaatcgttccatgcttggcgtagacggactccatggtcgcgccttggcgcaggctctcccgcacctgatcctcactcttgatcgtctcaaaagccttctcaatcacctcgtcggcaatatccttggggatcacagccacgccgtctatatcgccaaagattaaatcgccgggattgattttcacaccgtacatgataacagggatctggcactcgttgatctcagcgcgtcccttggaggtccggggatcgtgccccgcataaaagaggggaaagtccatctcctttaacgctttcagatcccgggcgtacccatccagcagaacgccggcgcacttcttgctattgacccgggtggcaaacaactccccgaacacggcgcagttataatcgccccgcgtcaccaggacataaatctcatcctcacccagctgatctaccaccttgcactgagcggtcagcgggctctcgggcatggagtacacggtggttgcaatgctggtgaacgcagggccgaaaatcactgtgtcgtctttcagcggcatcaattccttcccgatactctgattgcgatagcccattccatccagtacgtcgcataggacaccggaatacatattctttttgacatactccttgtcgtactttttcatagctgattcctccaattttttattaataaattcaaatctgcttcgcataaggaattctgttgaatgggtgcttgagcggttcgccattcagtccgcgcaccacttcctcagccgcgctggtcagaagggtaaattccgcttcttctgagtaccatgcggcatggggggtgatgatcacattgtccagctggagcagcggattgtccttttcaatgtgctcctgggccagcacgtccagtcctgcacctgcgatctgcccggcttgcagcgcctggagcagatcctgttcctgaatcacgccgccccgcgcggtgttgatcagaaaggcgccgggcttcatccagctgaagaattcccggttaattgtttcttttgtctccccggtcagcggcaggtggatcgaaaccacgtcgctctcccgggccacttcccgggccggtttcaaggtgattccaaggccgctcacctgctcctgtttcagataggggtcataggcgatgaccttcattccgaacgcttgagctttcctggccgcacaccgggcgatcgctccgcatcccatcaggccgaacacctggtcctgaatacggtgtaccggttttgtcaatgcatagtcccagactccttcccgcactgtgcgggtcagaatattgagcttcttggtaatggccagcatgagcagaatagcatgggtggacacatcctcgatcccgtagtcaggtacgttggctaccgggatcccggcggcagtagccgccgctacatcaatgttgtccatacccaccgcgctgcggacgatcaggcggcatttgggcagggcattgatgacctctctggtgagctgggcaaaatggacctggaccgcatccgcatccctggctgcccggataatctcctccgatgtcctgcactggtgcgggcggaagtcaaagcctgcccggtcatagacgtcctgaaagggctgaatggagtcatacatatagtcggtcaacacaacgaccggcttgtgatccagctttatcgacataaaaatcctccgtctaccgggagcgttactccactgatataatccgatgcctctgaggccagaaagactgccgctgctttaaacgcctctgggtctccccactctccggcaggaatccgggcgaggatctcctgattgcgtaccgggtcatccatcaggggctgattcatgtccgtggcgatatagccgggggcaatagcatttacgttgatgccctttgtgatccactcattggtcagcgcgcgggtcagccccatcaccgcggtctttgcggccgtataggccggtacacgataaccgcccagatagctgagcatggaggcgatgttgatgatcttgcctttgtgctgtttttccatctccctggcggccaactggctgaggaaaaagaccgcgttcagattgagagctatcacggcgtcccaatcctcccggctgaaatctacgctgtccatccgtttctgcattccggcgcagttgaccagaatgtccagcctgccgcccagcagctccatgctccggtggaacgcatcgtccagctgggatcgattcgtcagatcggccaccacgccgtccgcagaaaatccccgctcccggaagaaatcccggaccttgtacatacgctcagagcggttgatcagaacgacttgggcgccagcttcacacaggccctcggccagataacggccgatcccttccaaagagcccaccccggtcacgatggcctttctgcccgtcaggtcaaacttttggatcatttctgtcctcataatagtcccccgtttatttcacgtagctcttgtcctgattgtagacaccaaacaccctgtcctccgggcgcttggccaccagaacccacatatagttgttgcaagttcccggggaggcgacagtgggatgatatcccatggggaataccaccatatggccctcccgcaccggatgaacgaccgcgtcgcaaaacccgttttcctccagatatgtaaactggaaccccagcttgggcgcaggcatatcgaagtagcagtaggtttcctccagggtcttggcgtgttcatggggcggccaactggtccagcacgcttccccgccgaaagtatagccgcacatcaggcgggaggcgggggtcttgtcattaatcatcaggaatacttcccgcttgaaaacaccctccccatgaatttcatgggactcgcccaaaggggtgttgggatcgaagcgaatgaaatggggctggccaatcccctcgtatttcgcgaaagccgcgtaaaaactacagtcctcctttgcggtcagcacacagtcggcatccgcgctgagatatacacagtccagtttcttcatgtcctcgtcaaaccaaccgtccattttggcgtgtccggccccggaaatcaaggcgatgcacatttcatattctccgctggacacggtatagctgtcccccgccttcaggttgatcctgttgatgtgggtgtattcacactcctgtttttggggcgaaatggcttcttggacaccatactccttggtggttgccacgttccacttgtacatatcttctcgtttcataatttcggctcctttctgcggcggcgccgcacgcatagctacgattcgatcagatgcctcaggcaactataaaggccgtgatttgcggcaccaggatgataaaaatcacaacagccagattggcgataaagaagggcatttcccccttggagacttcttctacgttcagcttggagatgttggcaatgccgaaaatgttgacggctacgggcggtgtgcagcacccaagagagttcatgatgcagaacatgataccaaagtgaatcccgtcaatgcccatagcctgaacaatgggccacagcaaggggaccaacagcaccgcgatagaggtaccgtccataaacataccgaaaatcaggaacaggacaaagcagaacagcaggaacactacgctgctcatgtgggaattgaccacaaaatcgctgatccctttggataggcccgtgtaggagaaaaagtaagagaaagaagatgcgcaggcgatgataaacatcaccgtagcactccccttagcggaagtcacgaaaatccgcggcaaatccgaccacttgatctcgcgataaacaaaaataccgatgaaaatggccaccaccacagcgattccggcagactccgtgggggtgaacagcccgctgtaaataccgcccaagatgatgaagggaatcagcaacgcagggaacgaatccagcagcacccgcagaaaacctttgacacccaagtgttggatacccgctttgggccacttctgccagttggccatgaccgccacgatgatgcagaacactgcggcagtcacaacaccccagaacaggccaacagcgaacatgtccgtgatagacactccggtaagcgttccatatacaatcatgataatgctgggaggaatgactgggccgaggccgccagccacagccagcaggccggcggaggtcttttccggatagcccatctgcttcatggaaggatagagcatggagccgattgcgatcacggtggcagggccggaaccggacagcgccgcaaaaatggcgcaggccaacacagctgtatagcccagtgacccgcgaattcgcccggtcaggcagttcacaaaaccgacgatcttaccggagataccaccgtctgtcataatgttgccagccagaatgaacagagggatcgccataagagaagctgcatcgataccagtgaacagcttctggctgatcatgaccagaggaatgtcacagtagatgaaactgaccacagcggagatccccagagagatggaaaccgggattccaataatgagagcgatcacaaaagtaccaaacaaaatcgcaatggtcatgccgattcaccctcctcttttttgtgatgcaagatcgtgttgagcagaataatgcattgggtgataaaaatcaggatgcatccggtcgtgatggatgcctgaggcacccaggtaggcatcccgactccaggtgtgaccgactgggcggccgcctgggtctgaaggagctgtatggaggtgaagcccaccatgccggagaaaataatggtgacaaccgtggagatgttctccagcacaccggccaccttgggaggcaggcggcgcaccagggagtcaatattgagctgtgagtggtcacgcaggcctatttcggcggcaaacaaaataatgtaaaccatgcaggccctcgcaacttcctcaaaccagccgatttctaatttgaagatattgcggtttaccacctgcgagaatacggccagcaccatcacagcaaacagggcgaagatcaggacccgttctattttgtcgattacagttacgattctcacaaggtttcctcacctttcttatgccggtaacgattgacgttcccgatcgatccttttccttccggtgaccccgttttgaacgcacggggcgccaagagagcggaaatgaactcacttttcagcagcggctaccatgtccagcatttcttgaggcaggctgtccgcaaactcgtcatataggggggcagtggcctctttcagagtctcgcggtcgatctcgatgatctccaggccggcggcctccaactccttgattgcggcttcattggcctccatgcacatctgtcgcccggcttcggcgccgtcccggcaggcctggaagaatgtatcccgcagatcctcgggaattttgtcgatggcactctgagagatcagcacaggacagacattgtagaagtgcccggtcatggtcacgtatttggcgacttcagtaaagccgtcagtcgcaatgttgctcaacgcgttctcgccggcgttgaccgtgttctgttgcatagcggtaaacagctcgttatagcccatgggagtagcaatggcgcctagggtgttgaaagtagccatgtccaggggattctccatggtacggatcttaatactcttgaaatcgtcgatcgtacgcacgggaaccgtggagaatacatgccggaaaccagtgggcaggtagcaagcgatggtgatgcccttctcctgcgccagttcattgagcttttcgcccaattccccattcagggcgttggctatctggtcgtcggtctcgaacatgaagggggcacccagtacagccaactctggaactacgctgcccagaaccgcctgattactgatggccatgtccagagtgttcatctgaatggcttccattgaaggcttaacatcgcccaattgggaactgggataaacctcgatctggatgcgaccatcggtctgtttagcgacttcttcggcgatccgttgcatggccagatgattagtagccgtggggctgtgaacgtcgctcagcttcagggtaatgacctcctgattaccggtactaccggagttgttcggagcgggagtgctggcagcgcccccgccgcaggccgcgagagacgacgctatggcgcaagtcagaatgagagaggtcagctttttcatttgtttttcctccatttcttttgaatcgtttccaagaggttaagttgttcaaaatatttaattaaccggtttcattcgcttctaaaaaatatgatcctatattttccgatatagggatcattatttcttcgtatatttgaacaatttaaccttccgtgcaaaacttattatatactttttaacatctaaatcaagagaaatttcacaacttttcctatttatacaaatctgatgtggaacttttatttaatcacaccaataatatccttattattatttatcggtttcatagtgaagaatactgcaattgtaaaatatatacctatggggaatacttaagaggtgatcaatgaagcgcaatcaccagaaaagctttttctccctccccagggaaatcggagggtgcaagtcgtgaaccgctgtatgccgtaatgataagttgaattggaaacaaaataaaaccgtccttttcgtttgaaaagaacggtttttatggagctgctaaccagatttgaactggtgacctcgtccttaccaaggacgcgctctaccacctgagccatagcagcatatacagacatccgtctgtaggaaaaattggcaggggcagaaggattcgaaccctcggcacgtggttttggagaccactgctctaccagctgagctatacccctattttgcccacgcaaagtatttacatactataaaaatccctgtggtgggccatcagggactcgaaccccggaccaaccggttatgagccggtggctctgaccaactgagctaatggcccgaaataagaaacatgccgccgcctctgcggcggcatgtttggctccccaagttggactcgaaccaacgaccctgcggttaacagccgcatgctctaccggctgagctattgaggaatataaaagaagatggaggccgcagtatgtttaccatactgcggcaggtgctggcaaagacctatcttcccgggcagtcacccgccaagtattgtcggcacaactgagcttaacttctgtgttcgggatgggaacaggtggaacctcagcgtaataaataccagctattgaaacgacatatttcaccgacggaagctccctcccgtatcgcctgccgcaaggctctgtatatcatcctccgccatccggcggccctcggcaaaaaactttagccggctgtgccgcgaatagtgggttaggcactgcgtttatacaggctgtgccgcgaacagtggggcagccgcagtaaatctgatttacgccgcgtcgatcaaaagttttcgcccgcctttttggggaggcgacgggtgagaaaatggccaaggcccctcacgggccttggccattttcgagggcagcgcccttatccccgggccgcagccctcataaaaagcgcggcccgcaggccgcaagacacctgttcagacgcaccgcctgcccccagcaggaagcgtgacagacgccgtgcggctggcgcgcttcctgcaagcactccaattccagggcaggttcagttaaacgatccccctccggacgtactggcgtgcgtccaatacggttgcgccaggcagaggtggggataacataaggggagggccggcggccctccccttgtgaggcgcgaaaaggggcgcagccgcggcttgtccgcgcccggcgctatagcgccggaaagccccgaatagccagccgggcaagcgaagcgtccggcggtgagcggcccgcagaccgcaagagcctgttcagacgtatctcccacccccagcaaaagccatgacagatgccgcgcggctggcgtggcttttgcaaactccggctttccgacctttctgaaaaaagcccccggcacgctgcctttcggcagctccgccagggacctcaatcaacccttattcccattcctgaatctcgggcacgtcacagccatagtcataatcatcccattgggcgcgataggcccgttcgatcgctcggcgatagatgcagtagccggcggtaacacagatcaccagaattgacaaaacaatcggcaccaccagccataaaagcgaaagaaacgtcttttccgtgctgtgctcatgcataaacatgccccctttatccgccggatgcggcggcagaatgcaaaatctggctctatgatatcgcaaaaatgcctggccgtcaaccagctgaaaaacaaataacactgccgcggaaacggcagtgtcgataagaaacaggtgtcacccggccgaccctttttatttagaggcggcggcgagctttttcataagcgcggactttttatgcgcggccgcattcttatgcatcagctttttcgcagcggcctgatcgaccttcttaatcgcgacgcggatcgcctcggcctgatcggcggcgcccgtagaaacggcggcgtcagccttcttcagaaccgtcttgaggttggtcctggcagccttgttcgcacgcgcttttttagcggcgacaagcacccttttcttggcggatttgatgttcggcataggtttacacctccttgcttggattgcataaaagacagtacaagttataatagcattctttttaccaaaaagcaatacctgtgccgaaattttcccacaaattctgtcaccggaacataatatatacgtaggttacgccctttgtgttgagattaggcaccgatctgttcgttgccgcgacgagctgcatgactgtaaatcccgtctcctcaatataagcgcccgcagatccgccctgcgccgcaacgcacgccgaataattaatcatatcgcccgcctggctggccataccgaccaaatttttatccacggcaaaaaccattccaaagcgcggccgaaaccccagggtaatgagccgttcctcctgcccgtcgcctgtataagatccgatgaccggcgcggctgcgttccatgcggcgcgttcctgcgcgctcacatggacggtctggtcggcgcggtgtcccgctaaggcggtatcgatcaaacgattgtcgctgttaaagtcctccatcttcggtttgtccgaaccgatccactggttcagcccaagcgtttctgttttatttgtactggccatatcaaattgcctcctttggcgcgggatgtcccgccgcgtcgaattcactccaagtcagcccgcgcgcgtcgattgccgccgcgtcgagttccatcgcgtcaagcagcgcccaggtcagttcgccgatatcgagcgcggcggtcacacccacgggcagcagccggcgcagcgcgcacatcagcgcgccgctgtcctcaaacagcccgccagacgtttctccgccgaccagcacccggcgctgtgcaggctgctcggtcagcctgaccgcacagccgagcgcgcgaaaatacgcctcaagcgcggcgcgcgaacagccgggcggatgcgccagcgccgcggccgcgcgccgcagcagcgtcccgtccaaaccggacgggacgccatacccatgcagcgcacaccaggctttgagcatttcatacggtgcggacagcgggtacagggcggctgttatgtccggcaaaagttcccgcgcctgggacagtcccgcgtcaagcgccgccagctcgttcgaaacagacgtaccgggccgcaggtcataaattccggcggctgccgtgcgtgcgtacagactatgctccatttgaagcccccatctcctccaccgttataacgcccgcgcgcaatgcctgcacagggccggctgtctgatcgtttaaaggcgcgaggacgctgcaattttccgcctgcccgccatccatcacaagctgataaaggcgcgcgcgcgtcagcccctctcccagccgcttttgaccaagcaggacgcgcacccgcgcctcaatggatgcgcgtgccgtttcaaacgggatgtcctgtgcaggttgtacggtgatatgcacatcgaccggtattgtctgcgcatcccgcactgttaccgacgcgcagagcgcgcggcgttcatcgagcgccgcctccaaagccgtttttacatctgccgggacctgctccatatccggcgccgtcacaagcagctccacatcgcccatctgcgcgccggcctgtacggccgcgtcggaaataccggggaaattgcacgcaaaatcgcggtaaaacgccgcgttcacaccgttcggcggttcctttatcgcgtcgagcagccgtctgcgcagcgatgcgtcgtcctccgtgtcgcgcccgcccgtaaacgcctccgggttcttcaccgaaatattcggcagggaagggtcgatctttaaaatccgtcccgccgccgcgtttcccgcgcgccccggttcacgtgcgcgcgcaggcgcggatgcttcttcctgcccgtcgccaaacgccgtgtcctccagcgttaaataagcggtttggtccgcggcaaggcacaatgtcccggcaggcacaatttcctccccgccggttttataccgcttaaacacaagcgtaccggacgcgtgcgcggccgcaatccgattcagcccgcacagccccgcataaagctccagccgttcgccgtctgccgtctggggcgcggcctgacggcgcgcctcgtcgagtacggcgcacacctgcgccagctccccggccagggcgtgaaagcgcagcgcaatgtccgacgcttcgtccggaagaaaacccgcaagctctttataacgcgccgtcatacgcgcataaagcgcctgttcatcatattgtttcaaacccgcacctccaattccgcctgcccgccgcccaaatcgagcgtcacacgcaccgccaggcggctgttttgcgcatcccattcacttcgcgcggcggctacgcgcgcctgcggcagcggcgtcaatgcgcgccgcgcatacgcaagggcgcgctcgttgcgcgccgcctgtccgcctgcggcgggcaggcggtacagctcgctgccgaacgacggatcgtgcggcaggcttccgcgccggaccgccagccgtatcgcagcgcgctgtgccagctcacgcgcgccgccgatcatcaccggcgttccatcgtgcccgcacacaatgtcgccattttccaataaaacatccatgcggcatccgcctccttttttaagctgttacacataccgtttgtccagcatggttaaaaaggtctgcgccccgtcctgcgacagcctgtaccgcacctgatggacaaacaggtcctcatagatctgcacgccggtatcgagccttgccgaatcgcgcagcgccacatcccaaaagccgggacagactgcctcggctacaaacttgccgagcatggagcggtgcacgcgcagagacgcgtcaagcctgccgcttgtaccctgcatatattccactgaagggatcaagtaacgtatgcgcgtcagtccgagcgcgtcagcctccggattgtcgtaggaatagctgtaaacgccctcctcatcgcggattacaaaacgcgtgatcggtgagtaacggttgtccgtaaccttgacgcttgaaaaacgcagcgcgtccgagacgctgtttgaaacaacaaggctgcccgccggcggccattcgctcggacagatgacacggccttcactgtcgatatacgccggcagggacgacgcgttgcgtgcaaaattataaaggacctcccactcactcatgcccttctgcacctggtaatggttaaaaattgcgttgttgtcgtacacgagcgtttcaaagccgtagggcttgatgtgttcgtcaaaaatccgctgcaaatcgacattcgtataaatccatggcagcgcctcattgtcgagcagcaccgctccgggtccgcgcgccagcagcttgagccgccgtcccgccgcgccggccgtcacgctcgtttcgtcaacgccgccgtaaaagagccgccgttcacccatgaccgcctcaaccgaatgaaaccccccgcacgcctgttcatacgggaataccgccgtaaaggagtcagccggcgaatcgaacgagcgcacaagctcccattcaaccggcggcggcagcgtcaccgccgcgccgtcgccgccgcgcgccgtcacagtcagcaccccgtccagcctcgccgtcataacgcggcctccacgccatattcaagaaagtcgatcacatatgcaagcacccgcccgtcgccctgcgcggtgtatgcaaaccggctgaccgccgcagtgaattgctcgccggtcggcaggtacagcgtcccgcgcaggccgggcgcgcaggcagccgccagcgatgccagcctgtccagggccgtgtcggccgtatcgccgaagacctccccctcgcaccgcgccgtgcggcagcgcgggcctgtatcctgcatggcgacgcccgttcccggcaatgtgtgcgccgccagattatgcgcccgggacagctcaatccggcgcgggttctggtcgaacagatatgttccaaactgcatccggttcaatgaatcgcctccatttcatttgtaatcggatgcggatacctgcgcgcctgtgcacgcaggcggtcgttgaccagactgagcatttgcgtatcgtcgtccgccgcttcataataaccggaccgctccggcgcggcgggcatctgctcaggcgtataggcgatcggctgcggcgtgtagtccgcctgacgaaccgcttccagcggcgcggcgggtgtggattgtccgttggccgccgtaatggatgcagtttcctgcgtttggcccacaggccgggccgtatccatatacagatcccatacaagcggcacatccatctttgccggataattgacagccgcgcgcgtctttgtaaagtcggaaaacaccttcatgttcgccgcaagctccgcttccagattcattccgtccccccagtctgtgcgtcccatgattcgttgaccgcgcactcgtcgtaccataccgcgtccgccggcgggcgcgccctgtcgaaggcctgatcgctgtgctcccaataaagacggcacaaatcagcaatttgacagagcgtaaagcggtcaagcgccccctcgggcgacgggacggcgtcctgcccgcgcaatgtctgaaacagcaggacgcagttataggcgagcgcatacgcctgcccctcgtcaagccccagcctgcacagccgcgggaccatctcccgcgcccggccctggtgcgccagccgcatggctgcgctctgcttttgaaaggtaaagtcccggccgagatagccagcggaaaacctgttttcggcaagcggtcccgccttcatgtctgcacctccatgcgcgtgcgcgccaccagcgtcagcgtctcatatacaaggtcgcccagcggcgttgattcatcaattgcggaccatctgcaatcagaataaataattttgctgcccgggcgcacaatcacaacgttaaagccgtcgagcgcatgaaaatcgacggtatcgccgtccatctgcggcgttacagccacgcgcgtcagctccaggacatggcgtacgcgcccgccgaccgtcccaaccggctcggccgatccaaacgcctccacatagcggctttcgcgcgttgtcttggctttgtagctctgtgccgtggcaaggcggcgcccatcaatttcgatatagatatccttacttgtcgggaatgtgataaatgccattgcctgcctcctttcgcattcaaacgacaatctccgccgcgacgacaatctgactgatttcaggcgcgacgcgcatggacagcgtcgccacacagacggacgcgtcgcacggatgcgccgtcacacgcggcggctcatagctgtcgattacgccgagcgcacgcttggcctcgagttccacagtgatttgcgaggcgatgctctcgcgtgtaacagcattgtttttcagcccgcgcaggcgcgtgccaaccgcaccgcgcaccgcggtgacaaccgcgtcgacagccagcgccgtggacagcgcggcatgaggcccttctgacgcatcgccggtccgtccggttgtaatggcgcgcacacatgccgcgccctcaccgcgcccttcaaacggcgctacccccgcgcgcagaagcgtttcgatctgaacagccgtcagcgttccgtcaaacggtttctccagacgcagcggcaggccgttgaggctgtttgtcccggcggcgttcgcggcggccgccgcgaacgccgccgccacttcggccgtgcgcgtccctgcgtcgcacgcaaccaccacgcgcgtgttgttaatctccgcggcggctgcgaccgccgcctccgcttcggcggcagccacgatcccaacgcgctcgcgccccatcgcacagcacgcatcgacatggcgcgccaaagctgcgcccccgccgtcgcttacaacggcaaagagatcgcgttccccctccagagcggcgaacgccgcttcataatccgcgccggcggctactgccagcacccgtgaaacgcccccggcaagcagcgcccgcgccatcgcgcacagcgtgctttcctcgccgaaggcagacgcatccgtataggaacgcacctccactgctgtaccagccggctcataaccggccttcgcctgtcccaccaccgcaatagccgcgcgcgtgcccgcggccgccgtaccgatgcgtatatccgtactggtatagacgccgggccgcatggaatccggcaggttaatcatcgcgctccatcctttccgcatgaaccaaaatttctttaaacggcagcccgtccgtatccggctcctcattcaatatcccgttgagaacagcgcgcgctgtcaaagacaggcaatcaagctcctggtcatacgtcagctcgccgcactcgatctgcgccgcgccgaaggcattttcacggcaaaacaacaggccacacagttcctcatagaccgcgtgacaacccggctgctgcccaaccgggcagatgatgtcaaaacgcatggtcagccggacgcgtccgcctgcgtcgcccggccggctggccccatccaggccgacagccacacagcagccccgctgcggccgtttttgcagcccgggcggatattccccggccacctgcacatctccggctgttgccagcctgccccgcagataacgcgtcagatcatttttaaacgctgtcagtgcatccatcctccacccctccttcaatcaggcgcgcttccgcccatctgaacagcccggcgcccccgtattcaaaatcatgacagattaaaatttcataaagtttttgcccggttttgattaccgcacccgcacaaacatgctccccgccgcctgttaaagggccgtagtaaaagaacctgcgcgggtctgtgcggccaaaccgtgtgtatgcgccctcggtacgcatctgcgtgtcccacccggccggctggatacttgcataaaaccgggcctgttcatcgccctgtactgcgacaagctggccgcaggcccgcagcgcctcattgaccgacacttccagattcacgttccatcacctgccacagtcccgcgtgtccgcgcgcgaaaagcggcgcggcgtccgcgaacagcgcgtcgcgcagggcgcgcgcctcctgcgccgaaccgccctcctccgagcgcgtcactgaaatatctccaaccttgaagctctgcgcattgccggtcgaacgcgccagcatatagcggtagttcgcttcgcccgccgcggccaaaatcagccgcagcctgttcgggtctgcatccgctggcaaaagttcctcaatgcgttcagccgccgcttcacacagcggggtccattcgcgcgcagcctgctcgtcaagaccggacaggcgcataaactgttccaatacggcttctatttccaaggatgacgcctccttttcctggttgtgcttgtgagggcgggggaacacatttcccccgcgcccccattgcgaaggcggcgaaagaagccgctttccgcggctttcgcgcgcggcggccgccgcgcgcgtgcgcgggcctgtccggcccgcgcctttcgccgccccgcttcccggtcacttcttgagctttaacaccttgacggcctgcgggaacagctttgcgaacccgctgatggacgtgacggccgcgcgttcaagctgcgtgtcgatcagcttgtcataatcgaccaggatatctccggccgtgaccatctcaagcgcgaaattcttgtcgagcgcgacaatcgtcccggccggcgcggcggcacagcggatcacattcgcgccgagcggggtgccgatcataccgctgccggaaaaattcagcccggcgaccgggtcgcgcagctcctcaacagccaaaagcttctgcatcatatcgggcgcgacaatcagcgtgttcatgcggaaatcttcaaactgggaccagagcgccagcagatcgtcatatgtaagcgcgccggcctgcgctgtctcgatggcggcagccgcgttgccgttggcgtcatcggcggcatcgccgttgatgagcgcgttgacagcgtcagcaagctgcgccttggtaatgttcatgccgatctgacgcagcacaaccgaaaacagatcaatcctttgaaatttgaccgcttcatacgatgccaccagcatccggccgcgttttgtcagcttgacaagattgtccttgagcttcacgaccgtctccgggatctcagcgccctcctgtacgatggacgcggccgtgtcgtgcccctcggcggtggtaatggtgcggtagtcaagcgaattgatcacagtctttgacgcgatgatgttggaaagcatgccgctttcatcaacgccctgcatcacagcgcgcgacacatattccgggaacagcgccgccgaatcgcctgttgaaaagaattttgagatcgtgtcgctgcccgcgccgctcaccttgatatcaaagcgtttgagctgccgctcaaacgcgtccagccctgccagctcgccgcccgcatactgcgccgacggatcgagcttttcaagctgtgcggtaaatggaatccccgcgcggtacatggatttgtcaagtttaattgtctgataattcgccatcttatttcctccctgtctcatccttcattcgccaaatcttcacttcaaggctgcgccgcttgtttgccgccgccttaaatcctgaatgcgccgttgtcctccggctctgtattttttctgcgtccaagctgtaagaacgcgggcgctttttcagaaaagcccttgcaaaacgcctcaagctgccgcgcgtcgagccgctcggccgtctccgcggcggccgccgggtcaagcgcgggcatagcgaacgcagccatgcgtacaaagtcgcggcgcagcccatccagtcgtacgcgcccctcctgggcaagcgcctccaattcacaaaggcgcaaatcaagagcatccgcctgggcctttgacagcgtcagcgatccgtcgggcgcacgctttgcctgcatgctttccgtaacatagccctttgtaacgccagcccgcttctgcgcgggaatggccacgaacgaccactcataagcgtcggttggttcaatcagttcgtgccagcaaatcgtgccgttatactgctggccggggatatgcgcgcacggttcggttcgggtatcggccccgcagatggaacagaccgcgcccttgaccgcacagccgacgctgacttcctttttaatccccgcgtcaatctccaaaatcaggtcggcattttttgcgcagcgtaccatataagcccacgcgcgcagcgcgcagtacggctcgttattttgtgtgcgccgctgcgcgtcaaattccacatctgttttaaaaatacgcgccgtctggttttctccttttggattatggtcaaaaagtccggtttttccaacgaacagatcgcccagcttttttagcgacggctgtggaaaccgttcgtagtcgcggtcaatctcattgtcgcagaggatcatggaaaaaacataaacctcgtccgcggcaagcggacggcgcgcgaacgcgctgatctgctcaagctgttcctctgtaacctgcgcgctgtcaacagcttttgtcaccattgcgtgtttcatatcagccctcctgtctgttttaaagctgcgcctgcaactgatccgcccgcagattggtcaggcgcgcgtttgcaagctccaattcatcctgcaaattgatgttctcccatatgatgtccacgccgcacgcatagccgcgcaaacgcaaaaataccgtgcagattttgaccaatacaggcgtcagcaggcgcctgtagctctcaagctctgaggtcaggatatccgcctgttgagcgctcatgcgctcagtcgtggaccaattcagcccaagcagaaacggcggcacgccaagcttggcgacgatctgctcgagcatctgccgcaccggcacctcggttgaaaccatttggctgtccgcgccgatcaccttgatatcaacgtctcccacggctacaaaatcccgtatcacaccgtgcctggccgcatccatcgcatcagcccattcgcgtgcaatgctgtccgcgatctccttggcccctgtctgatcaggtgcatcaggaccggggcggtatgtcaccgcatagcgcagattgcccatgcgctcaaagttctgcccgatcgaggcgtatattttcataagtatgtcgctcacaaacggcaagccccgcagcaaagagcatccataagcctggccgggcggcggatccagcgccgagaacaggagcagttccggatacggtgcgggcgccggcgtaatcccatctctgtaaacataaatttttgcctccagcggcgacgtcccctgccggacacacacatccgaaagcggcgcgatgtaaagcccggcaacggaccggccgtcagacgccgccacaatctcgccaactgcattgccataggtcagcaggctgtccagataagaccgaataaacgcatccatgccgcgtgcggcggccccaacacgcacttccctgaaaaaagcctccatctcggcctgtgcacgccggtctgtacagaccggcgcacagccgccgacaagacgcccgatcttgccgatggccgcgtcaatcaccgggatcgactgacgcagtccgtcatatacggcccattcccgccagtgcggcggctgtacggtatccgctgccgggcgtccgcgcgctgtctgcacagcggccgcggcagtctttttcatacgtttccacaagcgcatttccatcttcctcctcccggtacgggggaacccaatcgtttcccccgcgccccttttcgcgcccgcgccctgcggcgcgggccttcgccgcctgcccggcggctcacccaatccccccggcgctgcgcgccgccccccttttccaaaggggggccgtctcccgtccaaccccggccacacagaagcctgtcccacggcgctcaagcacggtcgacacaaaataacgcagatcgtccatggcgtggtcgtcgcgcttaagcggcgtgtcgcggccggcgcgctcatcccagcgatacagaccgaattcccgcagaatatccgcacagcaggcgcagaacaagagccgtttttcccgcaggcggcggctgaccgcctgaatgccttcggccacttcattgcgggcaggcacgacgcggaaccggccgtgacggcggatacaggcgatgaagctggcggccgacggatcgacgatcacagcctccacccgcctttcccccgcgagcgcggcaagcgcctcgtaatactgctcatcggtttttacctcgcctgtacgacgcgaatcgtgataatattccgcaatgcggtaccatacgccgccgctttcgccccacagcccaaaggacgccgggttgacagtcccataatcgcacgatatgtagaagcgtccgcattgcggcgcgtgctccaccacatgtacagccggatcaaacatgggataaacagcgccctgcgcggctgtccactttccaagaacaaagcggtcgtaaaacgtcccggcatacaggcgttcataccgccgcagcacggcttcggaaagcgaaggattatctcgcatggtaaaatgcaggtaaagcgcgcttttctcatgcgcttgtaaaatccattctgtataaaaccagtgctgcggatgctccggattacaggaaaaccaaaagcgcgcgcgttcatcggagcagcgcgccaatgcctgttcgacaaaggaacgcggcatcaatgccgcttcatcaaataacacgccggaaagcgtagcgccctgaatcagcgcggcgctgccctcatcccgcccgccgaacagatagaaccggtttttgcgccgctttcccgctacgtcgatgtatccgcgcgcgcggttctccctgactgtgtagccaagcccgcgcagccgcgcgcaaagcggatctgtcacattgcggcgcaaagcgccggcggtttttccgcagaatgcaaagtcgcatccgtcaaaatccgtcatagcccacagcataaaccccagagagagacaataggtttttccgctgcgcaccgccccgtcgcagatcacagcacacaggttttgatatggactgccgggacaccaccaggtaagcgcggcaagctgttttctggaaaagcggcgcgccttatccatgacccgccggcgcctccccatccgtcccaagcgtgcgcgccgaaagcgacagcgcctccagaagcgcgtccccgccgcttgtgccgcccatctccgccagcatggaaagcgcgcgcaggcggtcaaaaaatttgatctcgactccgcctgttttcgccagcttcacctcggccgcatggaacagatcgcctccggcctgctgtccatccaacgcgccggaagcgtcgccaagcgcgatgcgcgtcaatccggcgcgtgccaatgcctgcggcggaaacatctcgtccagatgtgcgcgcagccgcgcaattctgcgccgcacgcgcgcgcggccaagcagtagattttccatgtccgcaaggccggcgcgcctcgcagcttcctccggtgaaaagccgcgcgcggccagcacgcaaaaacaagtttccttttgggcatcccataaacgccccacatgtatcacacccctttcacccatacccgcgcacaggccaaaatttgcgcgaaaacgcaacttttgcgccttttttcaaaaaattttttccgccggacggtatcagccccccgcgcttgactaaaccagcgaaagaatggtacattataaaaggaatttcctgcatttttgaaaaaaggcccgcggcgcgcgcggccctgcccgggccgcacgccgcaggccgctccggcggcctgcggctcatcgcatgcgcgagcgcgcctctttatagaaaggaacggccatggcgacactcaacatcgtactgatcgagccgcagatcccccaaaataccggcaacatcgcgcgcacctgcgccgctacgggcgcacgcctgcatttggtcggaccgatgggctttgaaatcacggacgccaaactcaagcgcgcggggctggattactggcatttgctcgatatcaccgcctatcctgacagcacatcgttttttaagcagaacagcggcccgttctattatttcaccacaaaggcgccgcgcgtttatacagaaccgagttacccggacggcgcgtatattgtgttcggacgagaagatgctggtctgccggaggagcttttgttccaaaatcgcgatcgctgcgttcgtctgccgatgatcgccggggcgcgcagcctgaacctgtcaaacaccgtggctgtggcggtttacgaggtgttgcggcaatgggattttccaaagctattaaacagcggcagactcacgcgctttgactgggaggcggccgggccgtccgaataacaggaggatgcatatggcaaagaaaaaaaacgaccaaaacatattgctgatgacggattcggccagcgatatcgccgacagcgacctgctcgacggcggcattgtcatgctgccgattccaatcaccatcgacagcactggctatctggaacgcgttgattttacgacaacggaattttatgagcgcatggcaggcgccagagagcttcccgtcacaagccatatttcctcgcttacctatgcgcgggcttatctcgacgcatttgaatcaggctatacggatatcatcaatacaacgatcacctcggtcggctcgcatatgttcgaggcggccgtgctgggcaagcgccagttttttgaggagcatccggaagcggcaggccgcatcaatatcaccatacttgattcaggcacctatacggccggctatggctatccgattgttgaagcgtcaaagatggtgaaaagcggcgcgtcagccgatgaaatcgtcgcctatctcgacgacttttatgcgacggttgaaatcgtgttcgcctcctattcgcttgaatatgcaaagcggtcggggcgtatcccggtcgccgccgcgtttataggcgacgtacttggcctgcggccgatcatctcgatcatcgacggcgtaaccaaggttgtggaaaaggtgcgcggcgataaaaatgtcgtgacgcacatcgtcgattacgcttatacgcgcgcggctgacaaaaaatcgccgaccgtcgtgatctgcggatcggtcgggcagtacggagacgacctgcacaaggctgtttccaaaaaattcgggcacgcgccgcgcgcccggtatcaggcaggcgcatcgattgccatcaactcggggccgaaggtggtcgccatgctggtgcggggagaaaagcgcatcaatacgcgtgcacgtgaacaggatttttaagcctgtttacctcctgccaaaggaactggaaagcgcgccgggaagcgtgcgcttgcaataatctccaaagaaaggcccgcgcagcgcccaaagcctgtcgaaaccggggaaaattgcgcaaaatgcttgcaaaaacagtccccatgatttagaatgtttcatggtataaatccacaatcaaaccggtacggattcatctgattttcataaaatgaagggtggaaaaagcaatgaactcttacaacaaaaaatcagtcgaagatatcgatgtctccggcaaaaaagtactcgtccgctgtgatttcaacgtcccgctcaaggacggcgccatcacctccgacaagcgcattgtcgcggcgctgccgaccatcaaatatcttttggagcatggcgcggctgtgatcctctgttcgcatttgggccgcccgaagggagaattcaagcctgagttttcgctcgcgccggtcgcagtccgtctgggcgagctgctcggcaagccggtgatcatggccaaggatgttgtcggcgaggacgccaaagcaaaagccgccgcgctcaagcccggcgaactgctgatgcttgaaaacgtccgctttgaagccggcgagacaaagaacaaccccgacctggctaaggcgttcgcttctctggccgagatctatgtcaacgatgcgtttggctccgcccaccgcgcgcacgcttcgactgcgggcgtcgccgattacctgcctgcggtctgcggctttttgatccagaaggagattaccgtcatgggcaaggcgctatcggacccgaagcgtccgtttgtcgccattttgggcggcgcgaaggtttccgacaagatcggcgtcatcaacaatttgcttgataaggtcgacacgctgatcgtcggcggcggtatggcctataccttcgccaaagcgcagggttattcaatcggcgattcgctgtgcgaggacgacaaggttgagcttgccagggaaatgctcgaaaaggcgaaagccaagggcgtcaagcttcttctgcctgtggataaccgtgtcggcgacaaatttgacgccaattgcagcgtcaaggttgttggcagcgacaatatccccgacggctggatgggcatggatatcggacccgaaacggaaaagctgttctgcgaggcgatcaagggcgcaggaaccgttgtctggaatggcccgatgggtgtgttcgagtttgacaagttcgccggcggcacgcttgcggttgccaaggcggtcgcggacagcggcgcggtttccatcatcggaggcggcgattcggctgctgccgtcgccaagctcggtttcggcgacaagatgacccacatctccacgggcggcggcgcgtcgctcgaattcctcgagggccttgagctgcccggcatcgccgccctcaacaataaataaagtgcgcaaagggcgggcctctgcccgcccttgatctttttcaagctcttaaaagcaatgctttttcatgtgccagaacagaatatcgggaggtcaacaaaatgaataaagccattcgtcaggcggttatcgccggcaactggaaaatgaacaaaaaccgcaaggaagccctggagctgatccgcgaactcggcccgatggtgaaagacgcgtcgtgcggcgtggtcgtctgcgtgccgtttaccgatctggagacggtgctcacctatacgagcctggaggcaaaaaatatcaaggtcggcgcgcagaactgccattgggaaaagtcgggcgcctataccggcgaaatctcggccgacatgctcgttgagatgggcgtcgaatatgtcgtcatcggccacagcgagcgccgccagtatttcggcgagacgaacgctacggtcaataagcgcgtgcgggccgcgctcgacgcgggcctgcgtccaatcctgtgcgtcggcgagctgcttgcgcagcgtgagcttggtgtcactgatgaaattgtcggactccagacaaaggcggcgctggccggcgtgaccaaacaggaacttggccgcatcattatcgcctatgagcctgtctgggccattggcaccggcaaaacggcgacggccgaacaggcaaatgaggtctgccattacatccgcgaggttgtcgccggtctttatgaccgcacggccgccgacggcctgaccatccagtacggcggctccatgaacgcgaaaaacgcggcggagctgcttaagcagccggatgtcgacggcggcctgatcggcggcgcgtcgctcaaggcggccgacttcaccgcgattgtcaacgccgcttccaactgacggcggcgcgttgaatgataataggaggtacccgcatgaaaaaacccttggcgctcattatccttgacggattcggatataacccgcgcgattacggcaacgcgattgcagcggcgaaaaagcccacgattgacagcctgtacgcaaactgcccgcataccctgatcggcgcgtccggcatggatgtcggcctgcccgacggccagatgggcaactcagaggtcgggcatacgaacatcggcgcgggccgaatcgtctatcaggaattgacgcgcatctcaaaatcgatcgaggacggcgatttcttcagaaattccgccctgaccgcagctatagaaaattgtaaaaagcacaattccgcgctgcatttgatgggtctttgctctgacggcggcgtccacagccatatcacgcatctttacggcctgctgcgtctggccagggacgccggcctgcacgatgtttgggtacactgttttatggacgggcgcgatgttccgccaacctccggccgcgattatctcgaggcgcttgaggcggagatgaaccgcatcggcgtcggccgcatagccacggtgatgggccgctattatgcgatggaccgcgacaaccgctggacgcgcgtggaacgcgcttataacgcgattgtcaacggcgagggcaattttaacccctctgtcgtcgatacggcggaaaagtcgtatggggcagaggtcacagatgaattcattgagccgactgtctgccagaaggacgccggtgttaaggataacgactccatcattttttataatttccgtccggaccgcgcgcgtgagctgacgcgtacctttgtcgatccacagttcaatggttttgagcgcaaaggcggccataagcatgtatttttcgtctgcatgacgcagtacgacgcaacaatgccgaacgttgaggtggccttcaagcctgaaagcctgacgaatacctttggaaaatatatctccgacaaaggcatgacgcagcttcgcatcgccgagacggagaaatatgcgcacgtaaccttctttttcaacggcggtgtcgaggaaccgtatcccggcgaggaccgcgcactgatcccgtcgccgcaggtcgcgacgtatgatatgcagccggaaatgagcgccttcactgttactgacgaagtggtcagacgcattgaaagcggaaaatacgacgtaattattcttaattatgccaactgcgacatggtcggccacacaggtgtgttcgaggcagcccgcaaggcggttgaagcggttgatacctgcctgggccgcacattggccgctattgaaaagatgggcggccgggcgctcatcaccgcggatcacggcaatgccgatcagatgtttgaggacgacggttcgccgtttaccgcgcataccaccaaccctgtccctctgtttttcttcggctgcaaagatgtaaagctgcgcgaaggcggccgcctggctgatctggcgcccaccatgctcaagctgctcggtctgccgcagcctgccgaaatgaccggcgaaagcattgtcctttgataaaaatcgtttaaacccattttttacagcccgacgtctctgcccattctgcgggcagagacgttttcatcatcgcggatgcagacagtttgatgcaagagcgtcgcgaaaagagcaagctgcggtcatttcagggatgtttacgccgccgcgccggctcaagccatacgccggagcgttcggctttttaaaaaaaggcaggcgcgtatttttttgactgctccggtacaaaataaggataatgacttgtcaacatccccaaaaaggattataatagggacaactaaccgcagcctcaagaatttgttcaatagaggaggacccgccatgagaaaaggtacatttattgcaaccgtcgcgcttctgatcgcgatcgccggggcgatcgttgcgtttgccgcctatttcaagcgccgcagctgcgcgctttgcgatgatctggacgatgaatttggcgacagcgatctgtacgatatggattattatgccacacaggtcgacgacgcgcagccgcacagcgacgaacaggacgctggcgatactgctaatgttcttgccgacgacgatattcccgacgaggaataaactgtgttcatgagatgaataaaagcggacctgcgctttcgcgcgggtccgcttttattcatcttttattcctcaaacagctcccggagcatctgtccggggttgtttaaaaactgcctggtcagcacataagcgtccgtatcactgtaagaaacgcgctccacgcccgcatgtgaaaactgatagatcgccgcgtccgggtacgccgtcaaaaccggcgagtgcgatgcaatgataaactgcgagccgttttgcaccagtatgcgcagccgcgcgagcagggcaagctgccctgtaacggacagggcggcctccggctcgtcgagcagataaagcccctgaccgccgaaacggtttacgacgagtgaaagaaaactttcgccgtgcgactgcgcatgcatggaacgtccgccgtagctgtcaatcagccgcgggccaagcggagtttcgcggtcaagctcatcgatctttgtggcaacgttataaaagctttccgcacgcaggaaaaaaccgtcccccggacgccgcgcacccctgacgatgtgcagcgcctgccacagcgacgcgtgcgaatcacttgttttaaagcaaaaattgcgtgtgcctccctctggattgaagccgcaggcgatggcaatcgcttccaaaatcgtcgattttcccgaaccgttttctccaacaaaaaaggttaccggcgcagtcaataccagtttcccaagccgccggaccgccggcagctccatcgcatagccgccgtccgcgccggctttcaccgaaatttcccggataaacaacccgtcgggcgctgtcgctcctgtattgacagtcccacgtctgtccgatgcttcatcaaagcctgcggctgcgccgcgccgtttcacagctcgagtatctggccccggtgcgtgtatgaaacgatccggccgcagtacagcgcggccgccgggtcatccatcagcttttggcacagcgcgtaatcatcccacagatgcattggaacaacatgatccgcgcccacccggcgcataaaataatcgacgccgaggatatatttatcctccaggcgcgggtcgacgggtataaatgccgtgtcaatctgctccccctgcaaaagatcgatctgttcccggtaacgccggcccatgtcgtcattatacgccctgctctcgccgttccagtgccaccagttaagatcgccggcgtgaaacacacagacgccgttgcatttaacgagaaatgcaacgccctcatcgtttgaacaaagcgcgcggatctgcgcatcgccgaccgtcctggtttcacccggccgtatgcgcaccgcgcctgtgcgcattggcacgtcgtgcgataaaatatagtgaattttcccggcccatgcctcccattggaaaatgaccggattaaaatggtcgtggtgtatatgtgaaacgaacacatacacgtcgcgtcccttaagcgcggacgcatcaatcacaccgtctttcaaagtaccgccgcgcggcgtatccttataataatcaaagatcattacaggcccgccggtgtcaaccaaaaaaccgctgtgcgccagataaacggctttcaacacgcatcctccttttgatttggcttgtccttccaattccaccatttacatttttcaggctccggtatgggcgtttcagcaaagtagacagcacagcggtagacatacagcacacacctgtccagtatgccgccgcagcgagcgcaatcgcgttcataaagcgcctgcgggtcctgcccacgaagcgactctaccgtatcaaagccaagcgcatgcagatgcgccgccatattcggacccactccgggaattttctcaagctcagatttcactgccggcctcctgattcattgagcgtaaaacgccacacgcacctgttttccccgtcggtaatatcaggataacagcttacacactccgtttgaatacggcagtcaatcacgcgtgcaaagtttgtatattcaacaagtcccaccggcttgcatggatgaaacgccatgcccttgcgcgcgcgggcatcctgaacccggcaggtcttgacgcaataagtcagcgtatttccgtcaagtacagcctcatgccggttcaggggcgcatacagccggaaggccagcgcgcggcgcagcccgtccagccccgcctgtaccggcaggccgagaaacgctttgatacgccgcgcctccgtttcagtaaagcgcgcccaagcgttgacatcatgttcgaccgcttcgtccattccccgttttttctcaatggattgaaaccacagcccgtcaagcgccagccaatttttcgcgaacatttcgcacagctcaatcagttgatcgcgcggcagctcatcgatacgctcatacttcaaatttaacatctccctcctggctttcagcccgcccggctgcgccgcaagcggcaggcagatacttcgctgacgcaggctgtaccaacggacggcaggagagcttaaccgtttgtatcctgtactccggcacagtccgcacacctgccccattcatccaacgacaatctgctcatcgtttttaccaatacattaaaaatcgcctgtttttcccgcgtgcagcaaaagctgtcgttttctatttctgttcgatatcccttttgaccgcatacgcagcaggaatgaatgtattttttagccgcaggattccaacggtcaatatacagtgaacggccccgttttatcagtttactatgtgacaacggcctgcctcctgtcatatcaaagattgatccagcgcaatgataatgcctttccggattctctctccggcacaatcacaagttttacaattgtatactgaatttttcttgttctgcacattcattggccgcaatcagcacatgttcttttccgaaccccggccgcgcgactgctcccagaccttttgagcggcgtggcaagcagccactgcatcgctgcgtgtaccggccgcgatcaaaaaccggttgttgtgacaaaagcgcaatgtcgcgataccagacagctttggcagctcctcctcgctgcggccagcccaatcagcagggaagggaatcttgagcgcatgagtctcatcgtcagccggcacaccctgcgcgctgaatccgccgcgctgtgagggatatacgacaaactgtgcgtcagaagcggacaacactgctttccacggcgcaaaccgttccaatgtgacaacgccacgcaccataccgcgcagagcttcctccacatagctgcgcgcgcgacacatgctccgcacgctttccaaacgtttttccaaaatcacctgtgcgaacgaaacagcctcccaaaagcatctgtcagccggctccccgctgtcccatccggggttaaacaacgcgatcaaaccggctgtctcgcttccacaaccggtattgtcgtcgagatcaagcggctggataaaatgctgatcaaaccgcgcggcttcctccgcgtccgggatgagccggtcgccgaacgcgcgccataaaagcccaaacgcggcatatggcacgccattttcgcggacaggcgcgccattttgatgatggtcgaaatcgccgccgccaatatcaaaagccaagccgtcaaagttctccggcaggcgcataacgcgccgaatcttaattttaggattcagcaatctgagcagtgccgaagaaaatacatcatcagcatgaaaacgtccgccatgcgtcacggcggaattaggaatcattgtcatgtaatgttaccttcctgtccttcatccccacacgcgatgagcgcgcatttttgcgcgcgtgtcatccgcttgatcgcacattcccgcctcatagccgcgctttttccgttgaaggactcaaaataaacaagggtgacaggccggcgcgcacgggtatatttggcgccgcgtcccgcattgtgcactgtcaggcgccgttcaaggtccgttgtccaaccagtataaagcgtcctgtcggcacagcgcaggatatatacataataaccgctctctgtgtccaagccatcgccccctgatcgcagcattgcctgcctggcagtgggctgacaggcatataaacaataccatgccgctttgcgaacatgatataatcggccatcggggcgcaagcgagccgccctggccataccatcaaaaggcggttgccgcgtaagcggcgagccgttgggcatagcccggtataataaccgctttgcggttattataccacagcaacaagcccattcgggcttgcctgccgcaaagcggcagtgaaaccggcaaagccggttttggctgtggtgtaacatgcgcagtccgctgctttgcagcggcagccgccatatggcggctgcaaacggctttgtcgtttgcactgcgcatattataccatgtgcggcacactgccgcaagcgggaatgcccatacccataccattactttcacgcggcttcaagctcccgcagatcagccagggcctcctgttctgtgtcggccgaaaacaggaacgtccctgtccgatcgaacacttccacatgcccgcgtacccattcaatcgtatattccatcatgaccgacactcctttcaaacagtcaggccctgccggcgtccatcagcggcggacgcccatatcgtaccggcgctgtgcgcggtatcccgcgctggccgctctgttgcattgccgcatcataaagcggtaaaatccaaatgacgccgcgaaccacagtgcagctccaagcattgtgatcactcctttcactgcctattttacagtgcattatgtcccataatccgtacagttttatgtatagagaaaaaatcccgcgtgaagcgataacgcttcacgcgggattttttctctatacattttccattttccctctgtacacacggcaatatttttttaccgggtttcaaaagcgcgagatttcttttccaggccgccgccagcaaaatccatgccagccgcacggcgtctgtcacgaattttgctaggggcaggcggcgctccccggcaagtatcttgcggcccgcaggccgcttcgcttgcccggccggctattcggggctttccggcgctataacgccgggcgcgaacaagccgcggctgcgcccctttccgcgcctcacggggcaggggcgggcggcggccctccccttatgttatccccgcctctgttcggcgcggtcgtatcgggcgcacgccggtgcgttctgcggtaaaccgtcaagccgtccctggcccatgaacccaacccagaggcaggtgcagcctgcataaatgctgaaacccgccccactgttcgcggcacagccgattaaagtttttcgccgaggccttttttcaaaaaggccggaaagttttttgccaagctttttttcaaaaaagcgggggcgcagccgacgaatgttttttggcttaccttttttcaaaaaaggtaagtgttcaaaaccgtgcgagcgaggtcagtaagctggcgcgcgacatgcggcggggaaacgattttagcctcgccgccaaagccaaacacccaggagagaaactgcgggctgaccgccacagacacagttgcataaaacgtttcgctgtccgcgcgggaaataaatgcatcgcggccaaaccggtcggcgacaacgccggccaaacggtttgaaaaccggattttaaccgtctcctcctcgccgccgaacatgccgaagatttttcgcgcgtacacagccatatcaaacctttcaaactgtgcctgtccgtcacgcgacagatcggtcagcgcaatgccgtccatcttgtcgacccgataatgcttgatcatgcccgcttcggaatcatatgcgacgagataatagttttcatcatcccaggtcagcgcccaggggctgacgagatattgcgcgccgccatggcggtactgcttttgaaacggtgcaccggcgctgaaatcgaccgtccactcaaagtaccggaatgtaatgcgcacagcctgtgagatagcggtatgcagcttgtcgatattataataaatgctctcattcatcgccttgacacggtttgaaacatagacctgacgctgcagaagccgcgcctggcgccggctcgcaaggctttccacctttttgatcagctcagttgatttcttgtgagtaataaagcgcgatgactgcacagcatcgacaagcagcttcagctccggcagctcaaaaatcctgtcagcgacaaaataacgccggcccgtgcgctctatatcaagcccatagagccgcagcgcctcgatatcgtcatacaggcttttgcgctcggcagatatgccaaaccctgcaagcgaagcgatcagctccggcatggtcatgccgtggtcttcgtcggtgttctccagcaaaattttcatcaggtacaaaagcttcagcttttgattcggatttttagccacgcgctttccctcccagtcagcgaaacagagccgcaatatccttctgcacgctttgttcaaacggcgtcagctggcggtcggccgcagaaatcagcgtgatattccaggcaaattcaactgtgtcaaacggtacgaacacaacccccgggcagtcgttcattacacgcggcaggtcggcgctgacgccgatccatccattttccaggcagcgccggtagatcacaagcgtttccattgtcgtttctgcgacgtcgggcgtaaaaccgtatcgccggcacaattcatgaaactggccatagcatttaaactggcgatccgccagaacaaatcttctgccacgcagcagcgccacatcgacgcgctgctgccttgcgagcggatcgccctgcggcgccacagcgtacatcggacgggacagcagcggcacacaggcaaaccgcttttgatcgaccggctcaagtgtgacgccaaaatcgattgcaccggaggcgacctgctcctcgcaggaaaaatcggtcgtctctgtcagctccagctcacacgggcgcaaagcgcgccggagctgctcaagctcaaccgcctggatcgcgagcggcacgcccatcgtcataccaagccgaatgttgtgccgttcatcgcgcagacgctccatatgatcccgcatacgggcgtaaatgccctgcatctcctgcgcgtagcgtacaaacacctctccgcttggtgtaagcgccagcgttttgcggccgcgttcaaacagcggagcgccaatttcattttccatgcggcgaatggccttgctcagcccctgctgtgtaatgaacagcttgtccgcggcagcggaaaaggttttttctccacataatgtcaaaaaatatgtgatatcctgaaagttcatatggttcgactctcgggttcctttccatgcatttatattataatagtataacagatcatacgcactttcacaactcatagttttataaccagaataaaagtttcttttcagacatgctttttcatggtatattaataaagagtttacaggcgcatacagatgtcctcggccgctttatgcctttaaatcccgtatgtgcggacgaagggcctcttacgtttatggaaaggattttgcaccatgaggaaattgattgcattcatgacagccgccatgatggccttgtctctggcggcctgcggaggttcaggcggctctggggacgcggcgtccggagcaggcgggggcgtctcgtccggagcgggcggcgaaattttattcggcgtccccgccgatgtctcctcgctcgacccgcagacgcagaacgacagttacagcgaggaagtcgtcaaaatggtatacaacacgctgtatgtctttgacgaaaacaatacccccgtcccaagtctggctgaaagctatgaggtcagcgaggacaaccttagctggacgttccatctgcgcacagacgttaaattccacaacggcaagacgctcaccgccaaggatgtcgaggcttccttcaaccgcgcgctgccggaggattccggctatatcacgacctcgatgatctcgccgattgagagcgtgaccgccgccgacgacgccaccgtcgtcatcaagaccaaggagccttacggaccgatgctcagtctgctgtgcaactataacacagcgatcatggattctgattttatcgagcagtacggccgcgatctgggaacaacggccgaaacagtcaacggcacaggaccctacaaggtggtgagctgggccaaggacgaggaggtcgtcatcgaagccaaccccgattatttcggcaataaggctcaggtcggcgccatccattatctggtcatcccggagtcgtcctcgcgtatcattgcgcttgaaaacggcgaggtcgacatgatccacaaggtcccgtccgaggaggtcgcgcgccttgaaacactcgagggcattaccgtgctcaagcagcccggcgtcggccagcgtctgttccgcttcggctgcaacgatgaaatcatgtccaacaccaaggtgcgccaggctctgaactacgctgtcgaccgcgacgccatccgcaaggcgctctttgccgacgtctccgaggagacgaccgggccgttggcgcccgccgtgttcggcagccacgattacggtccgatcaaacaggatcttgaaaaggcaaaggccctgctggccgaggccggttatccgaacggctttgatacaaaaattgtcaccaccacccagtatgacaaaggctccgagcttgcggagatgatcgccgcacagcttgcggaaatcggcgtcaacgcgacgatcgaagtgctcgaatggagcgtgttccgtccgatgatcagcggtatgacagccgaggaatttgacgcgccgctctttatcatgggcgcgggcacctcgatggcagatgccgacggcggctaccgcggcctttacaccaccacgcccgacggcaaaaacgaccgcaactacggcttctattccaatgccgaggtcgacgaatatatcgaacagggcatgacggaaaccgatcctgaaaagcgcaaggagatttacgccaaggccggtcagattctttatctcgacgaccccgccggcatctggctttacgatcagctcaatgtattcgcctacaacagcgacaaaatcgatggcctgcgcgtcgacgcgctcggctgtgtcctgtttgacaacgcgactgtcaaataaccaaaaggcggacgtttttcgtatgggcaggggacggtcccctgcccatactttattatctgccttccaaaaaatgaaaggtccccacggggctttcccatacatttgatatcagaaaaggagtcaaagccatgtctacatatatgcatatcgacgttactgatacaaccgcaaccaaggaaaccgagattcagttcaaccgctccaagctgcctgtttccgacgaggtgcgcgcaatcgaccgcgagctggaagccgatccttccaactgtgaattatggatgcgccgcggcattgcgctgtccaagcagatgctttttaaggaggccgtggaatcgtattccaagggactcagcttcaacccgtttcacgctcttacctaccgccaccgcggccaccgctacctgtccatccgctgttttgaggaggcggctgcggactttgcgctgtcggcgcgtctggacgacaccaactgggacacctggtatcacctggggctttcctattacctgctcggcgactataagcgcgcggccggggcgtaccgcacctgcctggaaaagagcgacacctccgacaaagtcgtcgcggttgtcgactggtactggatgaccgccaaacgcctgggcgacgagcggcttgccgaggcgctgctcaagcgtgtcgacgaaaacaccgatcccggcgaaaacctctcctacaagcgccgtatcctgatgtacaagggactgatcaagccggaggagctgatgcagttcgagggcgccgagtttccggatctggagatcgccacgcaagggtatggcctgtcgaattattactatgtcaacggcgaaacggataagagcaacgccgtgctcaagcaagttctgaccatcaagagcttttggagcgcattcggctttttggccgcgcttgtcgacgcgaaaacacgcggactcgattacgagatcgtcgggtcactttaaccggaaaagagggagcgtcccgtgcttggttacaccatcaaacgaattttgcaggtcatcccagtcctgctgatcatttcctttatctgctttatgatgattcgccttgtgcccggcgacccggtggcgaacatgctcggcgtcaacgcctccaaggaggcgattgcggcgcagcgcgcggagcttgggctggacaagccgcttttgacacagtacggcgattttctcgtcaaggcgctgcagggcgacctcggcaaatcgatcaccacgcgccgtccggtcatcgacgagatcgcgcagcgttaccccgccacgctgaagctggcgctcggcgcgaccgtctttgccgccgtggtcggcataacattcggcgttctgtcggccgtcaaacagaacaagctgaccgacaacgtcatcatggttttttcgctgctctccgtgtcgacgccgtcgtttttcctcgcgcttgtcatgatgcttctgttctccatacatttgggctggctgcccagcatggggctgcgcacgccgcttcattacgtgctgccgatcatcacgcttgggatgcagtcggtcggtctgatcgcgcgcacgacacgctcgtccatgctggaggtgctgcggcaggattatatccgcacctcgcgttcgcgcggcatttcgcaggctgtcatcgtcatgcgccacgcctttaaaaacgcgctgatcccggttgtcacggtggtgggcctgcgcttcggcggcctgctggccggttccatgcttgtcgaggctgtgttctccgtgccgggcatcgggcgtttcatggtcgacggcgtgctcaagcgcgactatcccgtcgtgcagggcacggtgcttgtattggccaccacattcgtccttgtaaacctggcggtcgatctgatctatgccctgatcgatccgcgcatcaaatacgattaggagggaaggcgcgtgtttaaaaacccggtgttccggcgctttatcaaacggcccgcctccgtcatcggcggcattgttctgatcatctttttcctgacggccctgttcggaccactgctgtgcaggaccgatcccaacgccatcaacccggacatctgctaccaggcgccgagcgccgcgcacatcttcggcaccgacaacctcggccgcgatgtgttcgcgcgcattgtctacggcgcgcgcgtgtcgcttggcgtgtcgctctgcggtgtgctcatcggcgctttcttcggcatcctgctcggcgcgatggccggttatttcggcaagtggatcgatacggtcatctcgcgcgccatcgacatcctgctcgcctttccggggctgcttttagccatcgtggtcgtagcggtgctcggcagcggaatgcagaacgtcatcatcgcgatcgcgttttattccgttccgatcagcgcgcgccttgtgcgcggcgtcgtcataacgatccgcaacagcgaatactgccaggcctgccgtgtgttcggcgcgtcgcacgcgcgcatcatcgctacgcacatcatcccgaacgcgatgtcgcagattatcgtcaacaccacgatggatcttggcacagcgatcctgaccgcttcgtcgctgtcgtttctggggcttggcgtccagcctcccaatcccgagtggggcgccatgctctccacagcccgcgacgtcatccgcagcgcgccgtttgccgctctgattcccggcgtcatgatcacccttgtggttttgagcttcagcctcgtgggcgacggcctgcgcgacgcgctcgacccgaaattgaaaaacagttgaggagggtccggccatggcagaacctatcttagaggtcaagggcctgaaaacatatttttataccgaggagggcgtactgcccggcgtcgacgggcttgacttcacgctcgaacagggcaaggtgcttgcaatcgtcggcgaatccggctgcggaaaaagcgtcacgtcactgtcgatcctgcgcatcgttcagtcgccgcccggacgcatcatcgccggggaaatcctttataacggcaaagacctgttaaagctcagtgagcgcgacatgcgcaaaatccgcggaaacgacatctcaatgatcttccaggagccgatgacctccttaaacccggtgttcaccgtcggccagcagattatggaaagcctgacgctgcaccagggcatgacgaaaaagcaggcgcgcgcacgcgccgttgagatgctcacgctcgtgggcatcccgacgccggagcgcatcgtcgacgaatatccgcaccagctctccggcggtatgcgccagcgcgtcatgatcgcgatggcgcttgcgtgcaacccgaaaatcctgatcgccgacgaaccgaccactgcgctcgacgtgacgatccaggcgcagattctgcgtctgatcgcccagctcaaggaccgtatgggcgcgtcggttatcctgatcacgcacgaccttggcgttgtggcggagatcgccaacgatgttatggtcatgtacgccggcgaggccgtcgaatacggcggcgtgcacgagctgttcaaaaatcccctgcacccgtatacagagggacttttgcgcagcgtgcccgtcatggggcggcgcgtcgacgcgctttacaacattcccggcacggtcccaagccccaaggattatccggcgggctgccggttctcgccgcgctgcgcccacagcgccgaccgctgccgcacggagcgcccgccgctgtatgaaatgccggacggccgccgggcgcggtgctttttgtgcgaggaaggaggcaaacgccttgactgatgagaaaaaaccgctgcttgcagtaagggacctgaaggtgtattatccaatcaaggtccgctctcgcgggatattttcccagaaaaagcttgtgcgtgctgttgacggcatctccttcgacgtgtatgagggagagacgctcggcattgtgggcgaatcgggctgcggcaaatcgacgaccggcaaaacgattgtccgcctcaaccgcccgaccgccggcagcgtgacgtacgacgggatggacctcttttcctgtccgccccaggcgcaggcgcgcatcagccgggaaatacagattgtgttccaggacccgtattccagccttgacccgcgcttcacggtcgggcgctccatcgccgaaccgctcgtcgttcacaaggcgggcgcgccggccgagcgccgcgcccgcgtcgttgagctgatgcgcgccgtcggcctgcgcgaggatgtttacgaccgttatccgcatgaattttcgggcggccagcgccagcgcgtcggcgttgcgcgcgcgctcgcgctcaacccgaagctgctcgtctgcgacgagcctgtttccgcgctcgacgtgtccattcaggcgcagattctcaacctgatgcagcagcttcaagcgcagttcggcctgacctatatctttatttcccacaacctgagcgttgtcgagcatgtgtgtaaccgcatccttgtgatgtacctcgggcatatcgtggagacagccggcacggaggagctgtttaaaaatccgctgcatccgtacacgcgtgcgctcatggacgccgtccctatccccgacccggagcttcacaaggatcgcgagccgctcggcggcgacgttcccagcccggtgaacccgccgcccggctgccccttctgcacgcgctgtccaaaggtgatggacgtctgccgccagcagcgtccgcagccagccgatctcggcggccatattgtaagctgccacctctatcagagccaagcgccctatcaaaaataagcctgaccgtcattcggtctgagaaaggaagacatccatgcaaacctccatgatgctggaattcccagttgatgaatatgaagccagaatcgccaagctgatcgccggtatgcagaaatacggatttgacgccgtgctgctctcctccaaggagaatacgcgttatttttcgggcttgcagtcgatcgtctgggacagcaagatcgcggtgccgggcctgttggtcgtgacggccaacggcgatatgacgattgtcagctccacaagtaaccagccgaccgtcaaggtgacgtcgtgtctcgagccggaccgcctgctcgcctatacgcgcacaaaggagcctggtttcccggacacgttccccaaggcaatcgcctacgcgcttgaaaaattcaaggtcagcggcgggcgcatcggcatggagatcggcacgggtttccgcgtcagcatgtcatatgccgatcagaaagctctgttctcgctgatcccggacgccgagatcgccgacgccgcacagcttttatgggagatccgccgcgtcaaatcgccgcgcgagatcgaggtcatgcgcgaggtctgccggatcaacgtcgcatcctacaagaaaggctttgagagcatcgtctgcggcaaaacgaccgaggaggagctttaccgcatcatgtgcgccgaaagctttctgcagggcgcggaaaacatcttgccgctcggtatccgctgcgggcgcgagcggtatccccagggcaactgcccgccttcgaaccgcgtgatcggcaaagaacccggcgaaatgatgcttgtagacggcggcccgtgctacaagggctattactccgacatcatccgccaggcagtttcaggcaagccgaccgatcgccagcagatgatgtatgatatcgctgtcgagggcaacaaccttggcctttccgttatcaaggcgggcatcccggccagcgaggtctgccgcattgtcgacggctttttctcctcaaagggtatggacccctacaaccgctgcaagggctggatgggccacggcgtgggcctcgatgtgcatgagctgccgacgctgtcgatggactgcgacgtcatcctggagccgggcatggtcatggcgcttgagcctgagctttttgacgctgaaatcggcgtattcggcattgaacagaactttgtcgtcaccgaaacgggctgcgagcttctcacgccagcgccgcaggagttaatgcgcctgccgatgtaagaatatatatgatgaatcgacggccgccgcaatccggcggcatgggaggaacgtcaaatgattgaacaaaaaagaatcggatttatcggcggcggccagatgggcgaagcgattttcagcggcgtcctggcaagcggcctggtcaagcctgagcaggtttccgtcaccgatgtcagcgctgaacgcctcgatacactggggaaaaaatacggcgttttcactgccgtcaacgacggcgcgaacagcggcgcgcgcgtggtgatcgaacgcagcgatatcgtcgtgttcgcaatcaaaccccagtatgcccgcccgatgctcacggcggtcagcggcgcgttttcgcctgcacagctcgttatttccatcatgggcggcatcacgctcggttttctggaggaatttttcccgcaaaaccctgtccttcgcgtcatgccgaatacgccgatgcttgtgcggcgcggcatcgccggcatcgccgccggcgcgcacgcctcagaggcggacagcgcgcttggcgtcgagctgtttaacctggtcggcatgtcgtacctgctgccggaaaacctgatcgacccgctgacaagcgtaagcggatgcagccccgcgtttgcgtatctgttcatcgaggcgatggcggacggcggcgttgaaaagggcctgccgcgcgacatggccatccgccttgccgcgcaggcgctggccggctcggctgagatggtgctccagaccggcaagcacccggccgagttaaaggacagcgtctgttcgccagcgggcagcacgattgtcggcgtgcatgcgctcgagcgcgggggcttccgcaatacggtcatgaacgccgtcaccgaaagctgcgacaagatgatcgaggtcggcaaaaaggcttaggccggcgaccggcccgacgcccagtccccgggatccctccgggtcccggggatttctgcgcggcggcgcatggccgccgcgccatccttcgtccgggaggaaccgttttgaaacagaaaatgctttttcaggctgtcctgccatggatcgcttattttaatatctgttttttctgggggacttcgaccgtggcgaataagcttgggtctacctccatgcatccgctgatggtgggcgccgtccgcttcaccgtcacaacgcttctgatcgctctggcggcggctgcgcgcggtgttcctctgcgtatcacccgccgcgactggaaaacgctcggcaccggcagctttctgatgtactttctcaacacgctgctggttctgttcgccgctgtacgcgtcgatgcgagcatttcgaccattgtgctctgtctgattcctgtggggcttgtccttgtcgattcgctcgcccagcgtcattttgacgttggaccgcccggtgtcatcggtatggcgggcggctttgccggcgtcgtgatcgcgtcggccagcgggctgctcggcggcggcgcggatatcggcggcatcactctgctgcttgcttcggtctgtgtatggagcgtgggcaccatctacctgaaaaaccgcacggtggaagcgcccttcatcctccagatttttgtccagtcagccgtaccggccgcggctttcctgctgaccgccttgttcaccggaaccctgcgcccctccacgctgaatctgggcggcgtgctgccggctgtttatatgggcgtggccgattccatcattgggcttggctcctacatgtacctgctcaaacggtggcccacatcggtcgtttccacttacgcatatatcaatccgattgtcgggctgatgatgagccatcttgtactgcatgaatccatgaatgcacagaaaatggccggcgcagccgtgatcctgttttccgtgctcctcatccgtgaggacggccgcctgacagcctggctgcgggcgcgccgccgcgcaaaagctggctgaccggatcccatatccggcggccacgctggaaatttccttcacaagtttttcaccaaacgctttgtgaattgccatcgctgacgaatatatataacagaagcatttatcagacagcgttgaaggaggattttcaatggcgttgccggtgatcggatccgtgttccagtccattcggatgatgggactcagtatgaagtggcagcagcgcaaggccgaccccacaatgcccagggaaggcgaggaccctcaggccgccatgctgcgcaaacaagcgagcgacacgcgtaaaagcaacgctatcgcatcgatccaaagcaagctcgattccggcggggaattgacgcctgaggagttggagtatctgcgcatcaacgcccccacgctctacgaggaggccatgcagatcaagcgcgagcgcgcgcagtataagcagcagctcgccaactgcaagaccagggaggaggccgatcagctctacatcaacaagatgcagggctatttgagcgcggcacgcacaatctccagcaaccccaatctgtcggtagctgaaaaaaagggccagcttgaacggattgcccgccgcatgatcggtattcagaccgaacagaagatctttatcaaaaacggcgattatgaacgtctgccgagtgaacaggagatcatagacgaaaagcgcgccggtaccgccgaaaaaagcggggagcttaccggtgcgcaggaatccggcagggagcaggacagcgagcgcacgcaggaagggaccgatacggctccagaatgtggcggcgatcgtccgcagagcgggacggacgctgaagaaaggcaggacgcggccgttcaaacgggacggagcgcgcatgagctggagcgcgcgctttatcgggagcttggcgtcagccggccgggcgatggagcgcgcatctatgatgcgaaaggcgtcgtgcgtgaattggattttacattcaaacgcaggacacgaaagcgtccttaaatacgcaaaagctgggccggacacatctgtgtccggcccagctttttatgttccggcagcgccggcgcggccctctaaaaggcgatgatcacgccgccgctgttgacatacatggagctgagtccgcctgtgggcacgacgaccacgtctcgaaatgggtaacgccgccttgcctcggcggcgacgaaggcagcctggcgctcgttatggcagtgggaaacgaccagcgtgcgctttgacaggtcggcgctgcattccccgatgatatcaaccaaacgcgtaaaagcgcgtacagagccgcgcgccttttcatacagcttgatttctccatgatcggctgtcataatcggccgcagagacatcgccgaggcgacgtaaccggttatacgccccatacgcccggatttgatcagcgtgtcaaggctttccgctataaagaatgtgcgcatcccgcggatgaatgcttctgtttttgaaacgatctcgtcaaagccaagccccgcctgcacatactccgcaatgcgcagggaaaccgccagctcgccggccgacgccgaacaggaatcaaatacatggattttctgattggggcgcgcggcaagcgcgagtgtgcggccgatttgggcgctgttataagaaccgctgagttttgaggagatggtgacggcaaacacatcgccctcaccggaaaacagccgcgcatagcagtccggcgatgggcaggccgatttcggcgcgctgcggctcgccttcatcgcagcaagaaagcggtcgcggtcaagggtctcatcgtccgtgtagctgacgccgtcaagcagcatggtcagcggcgcctgttcggcatgcagacgcgttttcagtgcgggaaccagctcgcagcagctatcagttaccaatctgtaaaatgccatagttacttcctttcccgggcggaccggccgcaccgtttggctttctccatcatactttattttgtccgtgaaatcaacgttcatttcatttccggcgtgccgccgcgttttcttgacaaattacgcgtgcaagggtatcattgaaatcgcaagtcatatttgaaaatcgattgattgaaacaggatctgaatatagatgggagcgattcctttgacgcttgacaaactgcccattgggcacagcggcaccatcctgacggtgggcggggccggcgcgctgcgccggcggctgctcgatatgggtctgacgccgaaaacgcgcgttatggtgcgcaaggtcgcgccgatgggcgatccgattgagctgcatctgcgcggctatgaattgacgttgcgcctagaggatgcgcgcgaaatcgaaatcgaggaggacacctccaaatgatattcgcattggcgggcaaccagaactgcggcaagacgacgctctttaaccagttgaccggctccaaccagcatgtcggcaacttcccgggcgtgacggtggagcgcaaggacggcgagatccgcgggcggcgcggcgtaacggtcgtcgacctgccgggcatctattcgctctccccctatacgagcgaagaaatcgtcacgcgggattttctgctcaaccagcacccggacggcatcatcaatatcgtggacgctacaaatatcgagcgcaatttctatctgagtatgcagcttatcgagctgaatattcccatggtcgtggcgcttaatatgatggatgagttccgcgccaacggcggcaccatcaagctcagacgcctgtcggaggagctgggcgtgccggtcgtgccgatctccgccgtcaaaaacgaagggatcgacgagctgatcgaaacggccatcgccacggcgcgcgaccgccgccgcccggcgcgcctcgatttttgttccggcgcggtgcaccgcgctattcatgcgatcgcgcatctggtcgaggaccatgcggagcgaatcggggtgccgccgcgtttcgccgcgacaaagcttgtcgaaggcgacctgccgatgctcgagcggctggagctttcacagaatgaacaggatatggtcgagcacagcgtcacggaaatggaaacggagcttggcaccgaccgcgaggcggcgctcgccgatatgcgttacagcttcatcgacagtctgtgcgcccaaacggtcgttaagcctacggaaagccgcgagcatctgcgcagcctgcgcatggataatgtgctgacgcacaaatatcttgccatcccgatttttctcataatcatgcttgtgatcttctggctgacgttcggcgtcatcggcacggctctctcggacttgctgtcaatggggattgacgcgctcacggccgcagcgtcggacgctctgacgcgctacggactcaatccggtcatccattcgctcgtgatcgacggcatattcgcaggcgtcggcagcgtgctttcctttctgccgatcatcgtcgttctgtttttctttctctcgatccttgaggacagcggctacatggcgcgcgtcgcctttgtcatggacaagctgctgcgtaaaatcggtttgtcgggccgttcgttcgtgccgatgctgatcggcttcggctgttcggtgccggccattatggcaacgcgcacgctttcctctgaacgcgaccacaagatgacggttttgcttacgccgtttatgtcgtgcagcgccaagctgccgatctatgccatgttcaccgccgctttctttccggagcatccggcgcttgtgatgatctgcctgtacgcgggcggcatggccgtgggcgttctgtgcgggcttgtgctgaaaaatacggccttccacggtaagcctgtgccgtttgtcatggagctgcccaactaccgtctgcccgggccgaaaaacgtcgcgctgctcttatgggataaagcgaaggattttctcacacgcgcgtttacggtcatttttctggcgacaatcgtcatctggttcttgcagacgtttgacacacgcctgaatgtcgttgccgcaggcggggaggcgagtatgctcgccggaatcggccggttgatcgcgccggtgttcacgccgcttggtttttccgattggcgcgcgtcgaccgccctgatcaccggcttttccgccaaggaggccgtcgtcagcactctggctgtgctcaccggcacgaacaccgcgacgctgccggcggcgctcgcgcagattttcacgcccgccgccgcggtcgcgttcttaacgttcacgcttctttatacgccgtgtgtcgctgccattgcggctgtgcgccgcgagcttggcgggcgttacgcagccgtcatggtcatggggcaatgcctgatcgcctgggcggccgcattccttatctatcacgcggcgcgtctgatcttttaaatgcgcatgtctataaaaaggcgcccctggaacctgtgttccaggggcgcctttttgttgcatccgccaatgcttcaaaaatcaaacgtctcggggtcaaagcttgtccgcccgcctgtgtccatcgcgtcgatggcgcgcatatccgcctcgtcgagcgcaaaatcaaacagatcgatgttttcaaagatgcggtcgcggtgtaccgatttagggatcactgcatagccgctctgcacattccaccgcaggatgatctgcgcgggcgttttgccataacgcgcggccatctcccggatctgcgggaaatcgaagctgccacgcacaagcggaccccatgcctcaacctgaatgccgcgctgtgtgcaccactgtgccagcccgttctggttgagcagcggatggcgttcaatctggttaactgccggcatcacgtcgcagtcctcggccatccattgcaggtgccgcttcatacaattggaaacgccgatcgcgcggatgcgtccctccttatgcagccgctcgagcgcgcgccaggattcaatcaagcgcgagcgtttctgacccggccagtggatcaggaaaagatcaagatagtctgtctttaattttctcaagctttcctcgaatgacagcagggccttgtcgtatccttggttggggttgtccagtttgcttgtcagaaagacatcgctgcgcacgatatccaggcgacgcagcgactcgcccagaatatgttcattttgatacatctgcgctgtatcaaaacttcgatacccagcttcgagcgcgtaccgcactgcgttgtccatctctttctggtcgttggtcttaaagacaccaagccccaccaacggcatttcaatgccattgtaaagcgaaaccacatgtctcatctaaaaccactcctctcaatgcgcctacggcgcttggtatcattataaaacaacagcatacatttgtacagaagatcgaataacggaattattaaaaaatatttgtctgtttgcatcgaaaaagcaaaatcgcatcgtccgctctataaataacaaacgctcttttatctgatgcaggcgccggctttcactttgtatggccaaataacagccatacattatggccattataacagccataatggactatgtaaaggggttgggcggcgtgatttcatacggaccgttatggaaaactatggcggaaaaaaaggcgacaacttacacattgagagaaatttacagcatcagccattcaacggtccaacggctgcaaaaaaatctgcccgtctcaacatacacgctcgaccgcctgtgcaaaattcttgattgccggctggatgaagtggcggaatatatgccggatgaagccttgtgagccacacatgacatggtcaggcagcagccctgtgccggccgtgcttcttacctgcacaatttaaagcacaggaggcaggaccgtgatacgatatcgtcctctgtgggaaaccatggccagaaaaaaagcgaccacctacaccctgcgggtgatatacggcatgagtcacgcaaccgttcagcgcctacaggcaaacctgcatgtatcaacgcatacgctggataagctgtgcagaattttcaattgtcagattgaggaaatcgtcgagtatgttcccgacggcgagttgtaatctcgcctctctattttccccggataaacagtaaaggagccatgcctttcggcatggttcctttattttgtctttttcagcacagtcgcttctattttggccaatgctccattcgtcatcgtttatcctcctcaaagcttttatttaaatacttgcatgtccatttttaatttttgtagttatatttttcggtatatcaagctgcgggaatttttcaacatattatagatgtatttttcagtattttcaaagctccttctttccataatactaagagaaaaaggtgtggagggggtaaggcgtggtaagctacgaaccgttgtggcgcacaatgcaggcccgggggctgacgacctacaccctcattcacaagtacagaatcaatccgcggacaatttatagccttaaacacaacctgggcattaccgtttatacgttagaacggctatgcaacattttagaatgtacgccaaacgatattttgaaatttgaataagaacctgtgttcacagccgccaaacgccgtgcgggcgggtctttcgcccctgctttgcgttaaattttttgccgcgccgcctctggaaatggcgttctgaccgccgccggccctgcatatactgccatagacagtaattgcaggggaggtttccgtcttgaaaggtctgccggaggaacgtgccatcacgttcgcgcactacatcattgaacacaatacaaccgtccgtgctaccgcaaaggaatttcatatatcaaagtcgaccgtacataaagacgtcacagagcgtttaaagcgcattaatccgctcgtttacgcacaggttaagcaagtgctcgaccacaataaatccgaacgtcacatccgcggcggaattgcaaccagggaaaaatatgcgcgtatgaaagcgcatggataagtttaaaaccaaagtggggtatggcgtgcgctatgccccactttgaaacttaataacgtttgtttcggcaagacgcacaagaaattgctgacaaaattgtacaaaaatcaattaaattccttgggtttttcggttgacattatttgcctgcccgtttataatagttaacagaaagttcataaaccatttgggttgttactggtaatgcaggcaaaaccaaattttgcatggctgagagggactgtgcgaaatttggtttttttgtattttgcggggtatttatggatgaaaattttaaaggcgatcaacaataatattgtcagcgcgcgcgatgaaaacggcaaggagattgtcgttatggggcgcggcatcggctttaaatgccgtgagggcgacagcatcccgccggaagcgatagagaaaatctttcacatggacacgcaaaatgaaaccgaccgtctcaagcagcttttttcctccatgccgcttgaacatatcgaggtcacaaaccgaatcatcgcctatgcccgcaagatcttgggcaagcggctcaatcacagcatctacattacgctgaccgaccacatcagcttttcggtcctgcggttcaggcaaaatatgatgtttcacaacgccctgctggcggaaatgaggcggttttatccacaggaatattccatcggccagtatgcgcttgacctgatcgccaaggagcttggcgtccgttttccggacgacgaggccgcgtcgatcgccatgcacatcgtcaacgcggaatacgacatatcgcttggagaagctgtcgacatcacgcacctgattgaccagatgctccggatcgtgcgcgattggcacagacgcccgctggacgagacttccgttgattttgaccggtttgtcacacatctgaaattcctggcgcagcgcgcgctgcgccaggatcgcccgccggcgggcgaccgggcgctctatgacgccatcgccgcgctctatcccggcgaaaccgcctgcgcgcaccgcgtcggcgcttatctgggcgacacgcattcatttttgatcggcgatctggaggcggcctgtttggcgatccatatccggcgtgtgacagcgccggacgcgtaacgcgctttttcagcacaattcggcgtgctgctgtgctatgatattggttgcggtatatggcttgtccattttcagcgtccagtatcttttgaggaaaacggcgcagactatactgcactgcgcgctagataaaagcgacaaagatgcgcggcatccgccgtgcaaacgagaaggttgtgacaatatgtttggaaagcttaaaaatatgttcggcgcaaaggatgcagccgtcatgattctcgcgcctgttgaaggggaggtcgttccggtcacgcaggtcagcgatcccaccttcggcgaggagattctcggcaagggggtggcgatcaagccggagcgcggccgcgtcgttgcaccggtgagcggcgagatttccctgatgtttgacaccggccatgctgtcagcatcgtttcggatgacggcgccgaggtgcttgtacacgtcggacttgatactgtgagcctcaaggggcagttttacacggcgcatgtcaagaccggcgaccgcgtcaagacgggcgatctgctgattgaattcgacatggatggaatcagcggggcaggctatcaggttatcacgcccgtcgtcgtctgcaactccgccgacttttcccaaattgaaacctttacaggcaagcacgccggcgaattggaggagctgatccgcctgcgcaaataatgaacggcaacccatctgcggatggagggagtgatttatcttgttcaaaggccatggaagaagcgtcttttccggcgtcgcaatcggaccggtctacgcgtttgaacgcgtgagtgccccagcgcgccacgtcccggtgcttgacgaggcgacggagctgtcacgctttcacaccgcaaaggagacggcagcttcacagcttcgcgcgctgtatgaaaagacgcggcgcgaaatcggtgaggacgaggcgatgatcatcgacgtacagatgatgatgctcgacgacggcgactacaacgacgccgtcgaggagggtatccgcggcgggtcgggcgccgacgcagccgtcgcggccgccggccggcagttttcagagtttttcgcctcgctcgacgacccgtacatgaaggcgcgcgcggccgacgtgcgcgacgtatcgcagcgcctgtccgacatcctgtgcggccgcgagggcgtgccggcgctcaccgagccgatggtgcttgtggcggacgatttgacgccgagcgaaacggttgcgctcgataaaaacaacatccttgcgtttgtcacgcggcaaggctcggccaactcacatacggcgattctcgcccgcattatgaacatcccctcgcttgtgcaggctgacgtgccgtccggggagaagctgcatgggcgcatgattgcggtagacggcttcacaggggagtattttctcgatccggacgaggcgaccgtggcgcgcctgcgtgaaaaacggcgcgcggacaccgagcagcggcgcgcgctcgacgcggtgcgcggactgccctctgtaacaaagtctggcaggcaggtgcgcctttacgcgaacattggcggacctgaggatgtccctgccgtgctctttaatgacgccgagggcgtggggctgttccgcagcgagtttctttatctgggccgcgacgactatccgagcgaggacgaacagttcgaggcataccgcaaggctgccgagcagatgggcggcaagcctgtcatcatccgcacgctcgacatcggcgcggataagaaggccgattactttggcctggcgcgtgaggaaaaccccgcgctcggctttagggcgatccgtatctgcctggagcggccggagctgttcaagacacagcttcgcgcgatctaccgcgcgtccgcttacggcaaggtagcagtcatgttcccgatgattatctcagccgacgagacgaaacgtgccctggcgctggccgccgaagcgcgcgccgagctggccgcgcggggaatcgtggtcgacgagattgaacgcggcgtcatgatcgaaacgcctgccgccgtcatggtcagcgccgagcttgcaaagcttgtcgattttttcagcgtcggcaccaacgacctgactcagtatacgcttgcaatcgaccgtcagaacgagcagcttgacaaattttatgatccgcatcatccggctgtgctggaaatgctgcgcgtcatcgcgcaaaacgcccatgcagccggtatctgggcgggcatctgcggcgaactggccgcggacgccgaattgacggacacgtttttgaaaatgggctacgacgagctttccgtatcgccgccgttcattttggagctgcgcaaacgcatccgcgacagcgcggtataaaaacttcggacgttttaaaaggaggggtttcccatgcgtgaaatcaagtatacgattacagacgaactgggcatccacgcccggccggcaggacagcttgtcaagcaggcgtccgccttcaaatgcgacatcaaagccgcttcgcccgcaaaatcggtcgacgccaagcgcatcatgggcgtgatggggcttgcgatcaaaaagggcgacgtgctgaccatgaccttcgacggcccggacgaggacgcggccgccgccgcgctcgaggcgtttttaaaggaaaatctctgatctttccctgccgtccatgctgcgggcggtttggagcatgacaactggggaatgccggttccctgtgggaccggttctcatagacagcaatcacaaaaggagggtatctgttatgatgaagtatttacagaagctcggcaaatccctgatgctgccggtcgcctgtctgccggcagccggcatcctgatgggcatcggctactggatcagcccgtcggttatgtcgggcgtcggcgacccgaacgtgttcgcgttcttcctggtcaaagcgggcggcgcgattattgacaatatggcgatcctgttcgccatcggcgtcgcgctcggtatggccgacgaccgcgacggtacatcggcgctcgccggtatcgtttcctggctgatgacgcagcttttgctgtcgcccgccgttgtgtcggtcctgaccggcgcggaggcgaacgcggctttcggcaagatcaacaaccagtttatcggtatcatcagcggtttaatcggcgccacctgttacaataggttcaagaacaccaagctgcccgacgcactcggctttttcagcggcaagcgcagcgtcgccattgtggccgcgcttgtaacaatcgtcgtggacctgatcctgttcttcatctggccggtcgtctatacggctcttgttacattcggcgaatggattctcagcaccggcccgatcggcgtgggtatctatgcgttcttcaaccgcctgctgatccctgtgggcctgcaccatgcgcttaactccgtgttctggttcgatgtggccaatatcgccgatatcgcgcgtttctggggcaccaaccccgacctgccgggcacgctcggcgtcacgggccagtatatggtcggcttcttcccggtcatgatgttcggcctgccggccgccgcgcttgcgatgtaccatacatccaagccgcagaagaaaaagctcgcctacggccttctgatctccgccgcgttctgcgcgttcttcacaggcgttaccgagccgcttgagttctcgttcatgttcctggctccgggactttatgtcgtgcacgcgctgctgaccggcgtctccgccgctgtctgcgccatgctgccggtgcgcgccggctttaacttcagcgccggctttgtcgactggttcctcagcttcaaggctccgatggcgctcaatccgtggctcatcatcccgatcggccttgtgttcgccgtcctctactacctgctgttccgggtcatcatcgtcaaattcaacctcaaaacgcccggccgcgaggatgacgacgatatcgaagcggaaaagaagatcaccatttccaacgccaattttgccgccgttgcggcaggcattcttgaaggtctcggcggcaaggacaacattacctccgttgataactgcatcacccgcctgcgccttgagatcaaaaattatgaacttgtcaacgataagaagatcaaggctgccggcgccgcgggcgttatgcgtccgagcaagacgagcgttcaggtcattatcggcacacaggtccagtttgtggccgatgaatttaaaaagctgctttaagctgctctgagggcagcggccgaaccggcggggacgggcggaaatccgcccgtccccgccgtatatcagcgaatacaaaggaggactttgctgtggaatatcaggtccgcaccatcggtacgcgctccgaattgccggcttgccccgtctttctgatcgaccatttccagtggacctgccggcggcggccggcgtcctgggggcgcatgggatatctgcgggacacagggctttgcgtggagcttgtctgcgaggagcgcgacccgctgcgcatttatcacaacccgcaggatcccgtctgccgcgacagcgcgctcgaagcgtttttcgcctttggggatctgccgggggatcctgtgcgtaacgacggcttttactgcaactttgaactgaacgccaacggcgcgatgtatgcaaagcttgggcgcggacgcaaaaaccgccgtccgctcaccccggaggaatacgcgctctgcgcgccgcgcgcgcagattggcgcgcaaagctggtccgtggagctgaccgtgccggaggcgctgctcgcttctcaattggggcgcgcgccattttcgcccggcgggcagttcttctgcaatttttataaaatttccgagtcgcccgacattgagcattacgccagcttttcgccggtcgacagcgaaaagccgaactttcatttgccggaatgctttgcgcgcgccgtgcttgtctgaagggcttttattttgccgcgcgcactgctataatgaaatcaaaccggttctgctgacaagcccgtcttaaaaagaggcggcgttatatttgtcgggcagccctgaatccgcgagaggtgatcgatatgagaatttaccgggcaaaggattatcacgacatgagccgcaaggcggcaaacatcatttcggcgcaggtcattatgaagccaaactgtgtgcttggactggctacaggatcaagtccgatcggcgcgtataagcagctgatcgagtggtaccataaaggggacatcgatttttctgaggtgcgcaccgtcaacctcgacgaatacaagggactcagccgggataacgaccagagttactactatttcatgcacaaaaatttcttcgacgccgtcaatatcccgccggaaagcatcaacatccccaacggcatggagtctgacgccgctaaggaatgcgcccggtacgacgaggtgatccgttcgctcggcggcattgaccttcaactgcttggcctgggccataacggccacatcggttttaacgagcctggggaagcgtttgaaaaggagacgcactgtgtcgcgcttaccgaaagcaccatcgaagcgaacaaacgctttttcgagcgcgaggaggacgttccccgctttgcctataccatgggaatccgctcgatcatgcaggcgcacagcatactgctggtcgtcagcgggcaggacaaggcggaaatcgtcaaaaaggcctttttcggtccggtcacgccgcaggtgcccgcgtccgtgctccagcttcacaaccatgtcactttggtcggcgacgaggcggccctctcgctgatctgaccgggtgcggcgccgcgtctgcgcctgacgggcgcggacacgctttgtatcctgcccgccgcaccgccgaactcttttttaccggaggtaccgctatgatcatcaaaaacgcgcgggtctttaccgaggacgccgcgttcgtccaaaaggacatcctgattgaagacggcgtctttacagaacaggccggcggacaaacaatcgacgccgccggctgctacgccatccccggcctggttgacatccattttcatggatgcgtcggctatgatttctgcgacggcacacatgaggcgatcaccgccatcgcgcgttatcaggcgaaaaacggcgttacagccatctgtcccgcaaccatgacgctgcccgaacccatgctcgaaaccgtctgccgcgccgccgcgtcctggaagcctgggccggactgcgcggcgctcgtcggcatcaatatggagggaccattcgtctcgcttgaaaaatgcggcgcgcagaatcccgcctatatccatgcgcccgacgcggacatgttccgacgcctgcaacatgcttccggcgggctgatccgcctgctggctgtcgcgcccgaaacggacggcgcgctcgatatgatccgtgcgcttgacggcgaggtgctctgctccatcgcgcacaccacggccggctatgaccttgccgccgaagctatcgccgcaggcgcgcgccatatcacgcacctttataatgccatgccgccgctttcgcaccgcgcgcccggcgtcatcggcgcggcgtccgacgcacaggactgcgaggccgagctgattgccgacggcgtgcatatccatccgtcggcagttcgcgccgcgttccgcctgttcggaaacggcggccggatcatcctgatcagcgacagcatgatggctacgggtctttctgacggcgattattcgctcggcggacaggctgtcaaggtcgtcggcaaccgcgccacgcttgagagcggcacgatcgccggttcggcgacaaacctcatggactgtatgcgcaccgctgtgcgcgacatgcacatcccgctggagacggccgtaaaatgcgcgaccgccaatcccgcgcgctcaatcggcgtctatgaccgccacggcagcattgcgccgggcaaggctgcaaacgtcgtcctgctcgatgaaaagctcgagatccgatcaatcgtcttaaacggcgcggtgctttgaccgtccataaatactgtctttataggataaccaaaaacacccttcctattttttggcggaagggtgttttttctattgaaatattttcctgaatgtcgtataatgtcgaaaaaggaggtaaacaacatgcaattacatggttggaaaaaaggaattttaatcagtttattcgcagttttgacagtcggatgtgcttctgaaaagaacgctgcgtcaagcgcgccatctgaatccgtatcgaacgcgccggtaagctccgcccaggagacaagctcagaggaagcggttgtggaagaaaaatttgtgacggtaggagatatcatccaaacagatgaggccgaaattacaatcaatcaaatttccttttcatatgacgtattgcccaaaaccaaaagttcgtattacattcactacgctgccgatgccggaaaggtatatatcgatatcgacgtcagcgttaaaaatttgaaaaaacagtcgcttttctgcgatgaagtcatgactgttatggcggattacaatgacggctttacctattacggctttccaatcgtcgaggacagcagtacgggattcacttacgcagacatatcggtaatcgatcctctggaatcgagggatatgcgctatcttgttgattgtcccgaggaggttgcgcaaacagaccatcctctgtatttgattttcaaagtgtccaaccaggaatacaaatgcatcttgcgcgacgaaacaacaaatatagttgacgttgacgccgcggtatcctctgaaaccgaagccgttgccagcgagcaaacagcttcggatgcatccgccgggcagtccgccgcagacgctgccggcggttccgctcaggcgtcccctgttcagcagagccagaacaccccgactcagccggactattccgattgggtgccatacagcactggttcgccggaaactctggcagaaaacattgcaaggggcaatgtggtctattacggcgggcaatacctcgcttctccagagtattatgcgatgctgagcgaatccttcgattccatgagaaattcaaacttctatccgacagaggaggaagcgcaggcattccatgaccaacatgcgatcccagacgatatttataaatattttgatgacgaagacgagaatgatattgcttcatatctggattgattcgatttgatggaaccatttgcaccaaccgcataaagcaggggaggtcccgccgcaatacggcgggacctcccctgctttatgctgattatgaccttttactctattttgccatccgcgcggcggctagtccggccgccatacctgtattccatgcccaatgcagattatatccgccgcattcgcccgccgcgtcgagcagctcgcctgttaaaaacaggcccttttggcggcgcgacatacaggtttccgggtcaatttccgaaagcggcacgccgccgccggtcgtctgtgcctgttcccaggagagcggacctatcacctcgaacggccaagccttgagctcatggacgagcgcagcgatctgcgcggcgtccatttcagcagccggacgcgacagcggcgcaaggccagccgatttcataacggcatagccgacccgtttcgggacggtcccaagcagccattcttccagcgtttcacatatgccgcggcgcgcgtcgagaagcgccgccaggcgttccggttcccagtccggaaaaaggtcgatctccagcttatacggcgcggccggcttccacagcaggcaggagagctgcaatgcggggatgcccgaaaggccgtaatccgtgaacagccattcgcccgcctgctccccaagcctgcgccccgcacaggtcaatacgccgcgcgcacggacgcggatgcccttcaaaccgcccgcaaaggcgtttttacatttgatcgggacaaggcatggatacagcggcgtgaccgtatgccccaaatcgcgggcggcctgatacaatccgcccgtaccgcccagcttcggcgcggccagaccgccgcctgccagaataacgcatcgtgctgtcacacagcggccgtccgcagacagaaccgcaaagccccggccgcgcggttcaacggccgcgacatcaaacttcagcgcggtgcagacgcgccgccgccgtatggcggcaagcaggcaatcgagcgccatcgacgcctgaaagcaataaggatatatttttccatcctccggcatactgcacagcagcccaagcccctcaaaaaacgaaagcgttttttgagccggcatccgcgcaagcatctctgtaagcgcagcccgatccctggtatgataatgccgcgcgctgatttcaagatttgtcaggttgcagcgtccgtttcctgtcgcaagtatctttttgccgacgcggtccatccgctccatcaggagcacgcgcgcgcccgcgccagccgccgtaaccgccgccgcaagccccgacgcgcccgcgccggcaatcgccacgtcaaagcctgtctgttccttcaatcaatccaccgcctgtcttaagaccagtataccgtctttgcggcggctgcgcaagtattcggatcgtctggcacgctctttatatgtgctaaatttacttttaatttcaaaaatggtataataaataacataaggaaatttcagggcgtaaaaacagacctgtgggaaaggaggcgtcaagcgctaacagcaatccgccatcccgaagcctttgactgtaacacgcttgtaaggaaagaagggaaatgtaatgggtaaaaaatgtgtcctgtcaagtacgctgctgaatcggtgcgatgccgcgcaacccatgacaggagggatgacgatgcgcaagcttctgctgatagccctgctgtccgccgcgctggcgggctgcgggcagggggaacccgccgcgtcccaggccgatgtgtcctcccaattgcccgcagcttcatcgcaggcggcgtcggagccggttgtatcagaaccggttgcgccggatgtttcaagcgccgtttccagccaaccggcggcatccgcgccgccgccggctgtcagcgccgcccccagccagtccgaaccgcccgcgccgtcaacggcttcgggcagcaaaaccccgtatattgaaaaccagattcccaatacggacggcacctatccgaacccgaatgatccgaacgaggtctccgccgccgaaccggatgaccatgtaatgagttatatgcaaaaggtggatgattttctggattactgcgacgcgatgatggaccctgatgtatacggcgggtacttatatccacacagcaacagcaaagttgttaccatactttatctggagaatgcggagccggtcgaggcggttgcggatcaatatcagccgggctgggacggcgaagacgcacgttatgtcgacgaacccatacagattgtatacgaacgggcggattactccatgacatatttaaggcaggtcaggcaggatattatcgacgagctggtccggcaggggtttggtcttccagctgacaatgaagtgtccattcgccgcaaccgggtcaacatctcgctgtatccacctgagtatgaagccgcgctggaatttttgaaaacatatccgcatacggactgtatcggcaatgtgacagatgcgtctgcgctgccgcccttgccaaatacataatcagacaggcttttcagcccctgtccgggggcagtaaaaagaaggcggacgcgatcgcgtccgccttctttttactgcttcgtcacaaatgagtcccggccttttgccgcatccgccgccttacggcaaggcatacacatatgattcgactgcaatgcatcccgctaatcgcggcggcgcagatggattgcaaagccgccgacctcctcctgcaaataaacggccacgacgcccgcgccgtccatgacaagcccttcctcccggaatgcgacgccatgcgcctgataccaggccatcgcgcgttcaatatggttgactgcaatcgccaggtgtccatgcgcgcccagaaacggcttttttaccagctcggcggctgaaccggcgaaccatgcccccggcagctccctgggcgcaaagccgaacaggcggtccagcgcgcttgcacagcgcgctgcctcctgcgcgtcggcgcagttcataccaacatggcatagctgcgggtcaaacatcgtctgcaccgccgcgcggcaaagcgtctcgatttcgtcgaaacgcccggcctccaccagaccggccggcgccataaagctcccgccgcagcagagcacattcggcaaactaaggtatgcgttcaggttatgcgggccgacgcctccggtcggtataaaccgggcctgctgatacggcccgcccaaagcgcgaagcgccccgacgccgccgctttgttccgccggaaagaacttcaggtctgtgaaccccattgcaaatgcctgttccacctcggtcgccgtggaaacgccgggataaagcgggatttcatggtctttgcaccaggcggcaaccacaggtgaaaaccccggtgtcacaagaaagcgcgcgccggccctgacagcggcctcggcctgatccacactgaggatcgtccccgcgccgagcagcatcccgggccgttcggatgcgatggccgcgacagcctgcgccgccgcctctgtgcggaaggtcacttcaatcacatcaattccggcggccagaagcgcgtcgcacagcggcacggcatggcgcgcgtccccgataacggcgaccggcagtatcccggcagcgtaaagccgttttgtacattcatgcatcggccggttcccccttctccataaaagcggcaagctgcgcgcgcgtcggcaagccgtcgttgtctcccacactcatgacctgaatcgccccgaccgcgttgccccggcgaacggcttcgcacagaggcagcccctccaaaagcccgctgaggacgcccaccgcaaagccgtcgccggcgccgaccgtatcgaccacctgcctgacaggaaagccttgcgcccaaaacgacttttccggcgtacaggcgtaagcgcccgcgctcccgttcttgaccacaacggttttcgcaccgaggccaagataaaaagcggcgatctcctcacaggtgcgcgcccctgccagcgtttggccctcggcgatcccgggcaggaacaggtccgcccgcgcagccaaatcgttgacaaaccgcgtcatcgtctccctgtcgggccaaagctgcggacgcaggttgggatcaaaggagaaaaacatcccttcatcccgcgcgcggtccgccagcgcgagcgccgccgcgcggcagccgtccgacagggcgggcaggatccccgtcatatgcaaaacgccgtaatgggaaatatccagtttctccacatcggccgcgcagagcgtcgatgcggccgagcccttgcggaaataaaagatttccggatcgcctgcgcgcaccttcgatttgagcataaatcccgtgggacggccgtcgcagaagcccgtaagctccgtgccgatgccgttttcctgcataccgcggacgatgcgcctgccaaacgggtcgtcccccagcttcgtcagatatccaaccgtgtgctccaaccggcgcaggccgaccgccacattgtattcagcgccggcaattgccgccgtatagccgtccacatactccaaagggccttcgttctgcgcgatgaacaaggccatcggttcgccggccagcaaaacgccttgtttcatatagttacccccttatccgccgcattgcgcggcacagtctcagtatgagcgatgattcacatgctgttctttttgcgtcacgccttccaggggatttttacgcccacctcctccgaaagcgcctcgatcgagcctgccacatcgtccggcagttttatcccctcgcttacggcgcgcgcgtaacgttcccattcgatttcgcctggggtatagatgcgcgtggagccttgggccttaggcgctttgcgcagcgccgcggccatctgttcattttgctgcacatacgcctgcgcgccgccgaacatctcgggattgacaaccaaaaacgcgtggctgacattgtttggcttgtcaagttcaaagcaccaggagacaatttcgccgctcatactggtggcggcgttggcaagcgcgccggtcaaaaggtccaccagaaccgacagcccgtaccccttgtgggcggccatgggctgcatggcgccctcctccgggtaatggctcggatcggttgtgggcaggccgtccttgccgacgatccagctatcgggaatctggcggccgtccttgcgcgcctgcaccaccttgagcgacgccacattgctcatggcgatatccagaaaaatcgagggggtgctctttgccggagcggcataggccagcggattgtttccaagcagcatcccctttgcgccgggcgcggtcatattggggtccacattgctgacgcaaagccccagcatcccggctttcgcggccatattggcgtaaaatccggccgcgccgaagtggttgctgcggcagacggtcacaagcgccacgccggatttgcgcgccttttcaatggcaagctccatggccctgtaagaagcgcattcacccatgccgttttgagcgtccaaaagcgcgtaggccgggccgtcggtcaggaccttgagagccgcgtggatatccatcccgcccgcgcggaattttttgatatagttatacaggtttttcgtcccgtgggagtgcgtcccatacgcgtccgtctcggcaagcgcctcggcgcagcggcgcgcgtcgccgctttccatgccctcatgctccagcgcggccgtgcagaacgcctttaaatcctccagcgcgatgatatgttccatcgaatcaacctttcaaatgcttattttatggggagcatctcaatatttttgttggggcagcggttatagcacatcccgcaggcgacgcactgcgtccggtcgatggccagcttatccggtccaatcaccagcggcgcgaaatccgtgcagatggttttgcagagctggcacccttcgccgcagccgcagtttaagcagcgtcccgcctcggcaatcgcctgctctttcgatgcgatcaccggtgcgtccgggctgtccgcgacataaccggcgcgcttgagcacctgcccggccgcgacaggcacggggcggggcgacggcttcagcacggccttttcccccataacccattgatccagcctgaccgcggcgttgtatccggacgcggcggcggcgatgatgttcgcgccgccggccgtgaacacgccgtcgcccgcggcgagccggacctcctcgctttgcgccgaccatacgctgccgcacggcaggctgacgcggctgccggccgggccggagagaatcagcgccccgtcctttagcgcggcgggcgcgtatccgttcaggacggtaatcccttcgccgcgcagcagggcggctttcttttcgggcacagccccggttggtatgacaacagcggccgccgcgcccatatgcagcgcgcagcgcgcgccgtccgcggccgcctggagcgggccgatcacagcggccgttttgcagagattttgctcccgcgccatatcgagaacagagcggacgccctccccgccgggcagcgccgcccaggggttgacgccggtccggcccacggctgcgcacacgcccgcaaatccatcctccagcagacgctgcggatcggcctgcacgccgcagcgcacttcgatgccgctgcctgcaatcgcttcaagaagcgcccttaggttctccgcagggagttgtcccgccgcggcggcgtcgttgaggccgccgcccaatacggccgcctgttcaaaaattgtgacggcatagcccgcttttctcagctcgccggcgcaggcaagccccgcgggaccggaaccgatgacagcggcgcgccgtccgttttgtaccgcctgcgcgaccgccggctgccacccctcggctctgccaagctccagcacgaaccgtttgagcgccttgatggcgacaggccgcccggtccgtccgcgcacgcaggcgtcctcgcacggatgcgggcagatataggcgcaggcgccctgcaggacgcccttgccggtaatcagctcgtaagcgtggtgaaagtcgccgcgcgcaatcgattggacgtatgcctggacggggacatggtgcggacaggccgccttgcacggcccggcaaggttcggctcccggatatgggcgtaaccgtcatgcagcgtcagctccggcgccgtcctgacggcggacaccacctttccgcagaagtcgtcgatggagcggtagccgtgcgtatccatatagtccttgagcccgcggatcatgggccggacgatatcatagccgctgatgagcgtttccgcgcagacgccgagcaggttgccgccgcacaggaccatctcgacggcggagcgccaatccgtgatgccgcccgccgccatcatcttcggctccatcccgcagaccttgcggatttcataggcgtcgcgctgcgccagcggtttcagccatgatccgcagtaacagctcatactgatctcgtcctgcaaatggtaaaccgcccggccgggatcgttcagatcgatgggcggcaggcccaggcggttgcccgtcgaaccgaccgcgtcggctcccgccgcataaagcgcggccgccacctgtgcaacctcgccgccctccggcgtgagcttgacaaacagcgggatatgtatctcctttttaatcgcgcggacgatctccgccaccacaccggcctggcggccgaggctggcccccgtctgctggctggtgctggccgcgccgcccgaggaaagcgaaacattgtacgacatattcggacagcacatattcagttcaataatatccgcgcccacggcctcaaattgtttggccatattgacccatccggcggcgccgcggtcgccggcataggtgatattggccatgaggatcaaatcgcttagcacctttttggcgtcctcaatcagcgttaagccctcctgaaaggtcaggcgcttttcagcggtaaaggccagggcgtttgtctcatcaaaaagcccgtaacgcggcttgcggttgatgtagggcgcagggtcgatggacagcttgatgctggcggccgcccatcccgtttcctcaatgcgctgaagctggcggacgttctttgtggtcggaccggaggccacataaaaggggtttttaaatgtgacgccgccgactttgacagggattctgatgtcctccaccatttacgcctcccttggatttttgatatgcctcccctcgcgggccgactggtagatcaggctgacaagctccatggcggccagcccgtcctctccgcgcaggcccgcgcgcgccggttttccggcggcgatgcagtctatgaaatgctcgatctcgctgacatagccaagatcgtatttttcatccacagcagggcgggaccatcccgttgtaagctccgccttttccacggtgtaatcaaatccagggatagaaaagccgcggatagcgctggagaacgtcagatccagatgcaggcatcccttcgtcccataaaagtcgatgttgtcctccatgccgccggtggttacataattggcttcaagctcggccgtcgtcccgtcggcaaagcgcacgagcgcgccggcccagtcctctccctccatggatttgtgcacaaggttttgctccagcccgccggaggtcagggcggtcagctcggtccagcgcccttccttcagggccagaagcaggcccacggggtggatgcccagatgaatcattgcgccgccgccgcagaaccgcagggattgggcgaacgggctgtgcgacccgcagtggcattcgcgcgcacggataaatttcacttctccgatcgcgccgcttttgaccagctccagcgccttgacaacggtggggcagcctagccagtcctcggcgtaataaatgttgcggcccgcgtcgtttgcggcctttaccatctcgcgcgcctcctgcggggtgacggccaggggcttttcactgatgacatggcggccatgccgcagcgcgcacagcgcggcgtccttatgaaggaagttcggcaggcagacatcgacaacgtcgcagtccacggctttgacggccgtctcataatcttcaaaaaaggcgcagtccgtaaagccataacgggcggcgaggtcttttgcgcgggcaatatccttatccacgatcgctgcgatctgcgccttttgccggacgcgcgcatagccatcggcgtgcagatcggcggaaaaggctgcgccgatcaggattacttttactttttgcatctataatctccttaaaagctgctgtatccaaacggttttttgacctgcatataatcaaacgcctggtccatctcctgtacagccagagcagtgaaccgctcaaggatacgcttgcccttgtctgcggacgccctgctcggctcgccccacacgccgcttggggatgcgcgaaagatgctgccatagccgagataagggcgctggacggcgggtacaaagtcgaccgcccgctccatgtgaaccagctctggagcgatgtgcagcatcagggacgtttccacttctcccgcgtgcagctccgtgtccgtctcggtgattccctcggcggcgacaacgccgaacaggctgcaaatatcgatattgaccgccataaaatccgggttgttcgtcgcgtttacctggcggatcacggcgggcaatacgaagatgccgccgtggcattgaagcgtgaccgcgcgccggaagccctgttccttcaggctcatcagcatgctgtacagcatgtggtaaaaaacatccgggtccatccagacagcgccctttttgcccatatgctcccggcatgtgctgaccggcagcggcggaatggaaaacccgcccgcggcctccgcgaccgcttcgccgaaggccgccgcgatgcggtaatcggtggacagcggcagatgaggcccgtgctgctcgatagagccgatgggaatgatagccagatccgtatcccgcgcggctagctcgtcggcggtcctgtcaaaaagctgcatacccccctccttacagcagggacgcgctgtccgcgtcgaggtaaagccgcgcgtccgtatgcctgcgcagggcgctggcggggcatcgctcgcagacaggcccgcgcagcgcgtccgcgacggcccgcgccttgcgcgcggtcggcacgacggcgatcgcatgcgggatggccagaatctggctcatggtgagcgtaagggcctggcggggcacctcgtcgatcgaagcgaagcagccgtcgtttacctgctgcatccggcacacgtcgtcgagggaaaccactttgacgcgtctggggtcgttaaaatcggccacggccgggtcattaaaagccagatggccgttttctcccacgcccaaaaaaatgagatccggaggatactcctccagcaaggcggtgtatttttcacacatcgcttcggcttcgtccggcgggcacgccatataaaacagctccccaaaggggacgcggtcaaaaattgcacggcgcaggaaattgccgaagccggcgctgtgcgcggggtccagcccgatatactcgtcctggtgaaacccccggacccgccgccagtcgatatcctgcccaagcagcgaagcgatcaggtcgtcctgcgaaggggccgccgcgaacacaacgttcgcttcgccttttttgtcaatcgcttcgcggatgatatgagcggccccccgggctgcggccgcgcccatttcggcgcgtgtatcaaacacatggacgggcaggccgtcgatgatttgctgttgcctttccatcgtgaaaagtctcctttatcgttgttattcttcgcgcacgcccagataggcggccgcaatatcgggatcgtccaacatctgcctgcccggaccggatttgaccatgcggccgttttccagaacataggcatagtcgcagatggacagcgatttttttgcgttctgctccaccaggatgacggtgatcccctcgtcccggatacgccggatggtgtcgaacacctcgccgacaatgattggggcaaggcccagagacggctcgtcaagcagaagcagccgcggcctgcccatcagcccccggccgattgcaagcatctgctgctcgccgccggagagcgtcccggcgtcctgtccgtgccgctccctaaggcgcgggaacagctcatactggcgctcgatcagctcccgcacctgccgcgcgctggagtttaagtatgcgcccagccgcaggttctcctccacggtcaggcccgcgaagatgctgcgcccctcgggtacctggatgacgcccgctgagacgacgcggtgggaagcgccgggcagattcttcccatcgaagcggattgtgcctgtgcgcttgaccatcccggaaatggcgcccaggagcgtgcttttgcctgctccgttcgaaccgatgatgaccgtgatctttcccgcctcagcatccatatccacaccgtgaatggcttcgatctgcccatagctgacatgcaggccgcggatttccaaaagcgccatcagacttcctcctcccccagatatgccgccaaaacggcggggtccttctggattttggcaggcgggcctacggcgatggtcctgccgaaatcctgtacatagatcgtatcgcaaagcgtcatgatgagatccatccggtgttcaatgaccagaatggagagctggaagcgctccttgatcagacggatgaaatcgatcagagccaaaacctcctccgggttcagccctgcggccggctcgtcgagcagaaggacgcgggggcggctggcgatggcgcgcgcgatctccacgcgcctctggatgccgtaggggaggttggccggccgcgcgccgctatgctgggagagatttaaaacctccaggcagcgggacgcctcctcggcgatgcgccgctcctcgcgctggcggcgcggcaaaaggaacatggcctcaaagaggttgtaccggcccgcctggtcaagccctaccttgacgttgtcgagcaccgaaagtccggcaaacaggcgcgtattctggaaggtgcgcgaaagccccatgcgggctacctgtacctgatcgctctctgtgatatcgcgccccagaaaggttacgcggccttcgctgtaatcgtagatgtgggaaagcaggttgaaaattgtagtcttgcctgcgccgttcggcccaatgatgccgccgacttccccctcgtgcagctccatattaaagtcctgcacagccttgacgcctccaaagcttttggaaagatgctctgtctttaaaaggatgtcagccatctgtgccgccctccttttttttgcgccgtccggacaggcgctccctgagccggctaaagctgagttcgtgctcacccatcaagccggacggacggaaattgatgattaaaagaatcaggatgcagtaaagaatggtgcggtattcctgcaagctctggccgaacagcgtgacgttgcgaaaaaattcaggcaggcatttgagcagcgccgcggagatgaccgcgccggtcaggctgttggtgccgccaaaaaacagaaatatttcctgttccgaggaagctgtccagccgaacgactccggcaggagcacgcggttttgcagcccgtacaggattccagcgaaacccgcgatcacagagcctaaaatatacaccttgattttaagcttgtacacgtcgatgccaaagcttttggccgcaagctcgtcgtttttcagagcgatgctcatgcgcccatagcgggaatatttgaggtttcgcacgcaaaaaatggaaagcgccgtcacaagcagcgcgagcggcagcagatgctccacctttgggattttggaaaagccctgcgagccgtttgtgatatcggaaaaggtgatgagcagggcggtgatcgtctgccccaatcccaccgaaatcagcgagaaataatccttgcgcaggcggacggtgggcatggcggccagccaggccaccagcatgcaggcgccgatgccgcccaggctcgtgatccaaaaggaaagccctgtttttgccgccagaataaaggtgatgtacgcgccgatcgccatataggccgcctggccgaggctgaacatgccggccagcccggtgagcgcgaaaatgccggtgatggcgatgatggagatggccgcctggatcagcagcccgacatagtaggaattcatagcatcgccccctataccttatcctgggcaaatttgcccgaaatgccctgcggacgcaggaacaaaaataccagcatgatgccgaacaggatggccggggtcacgctggaacccaggaaatagatcgaaaccatttcgatcactccaagcaggatcgccgcggcgatcgcgcccgaaaggctgcccaggccgccgatgacagaagcgataaagcccttgaccatcatcgaggagccgagagcggggtagaccgaatacttgatgccgagcagcgtacccgacacaccagccaaaaagccggccagcgcgaatgtaaaaagcacaataaagccggaattgatccccatcaggcgcgaggcccttgggttgatcgcgacggcgcggatcgccaggccgatctttgtccggttgatcaacagcatgagcacaaccagcatggcgattgaaaccgccagcacgaccaaatccatcgtggcaaacgacgcacccagcagacgcaccgaggcgacctcgaacatgccggggaaaccataggaggtcttgccgaaaaagacggtgaggatttgttcgatcagaatagcaaatgtgatcgaggccacaaagtagtaaatgttggggctgttgtttttgcggatgcggcggtaacacagcgtgtcgagcaaaagcgccacgcccaggctcacaaccgccgtgaaaagaagcgtaacccacagagacggcggcgtttcaaaggatgcgtaaaagaaataagcgatgtacgcggcggcggaaatcatgccgccgtgggcaaaatttgaaaatttcaggatgctgaacaccagggcgaagcccacagcgatcagcgcatagactgcgccaagggaaatgccgttgacaatcaattgcaggctcaagcaaacacctcctgacagataggggctgccggaaaacaaaacgccgcggccttgggcggccggttttgccggcagcccgggcagggacgccgctgtaaagcggcagggcaaaataccgctcctgccgcttcacggctgtttcgcaaaacgcaaacggttctactgatcccattcttcgctcagggtataggtgtcaatcaccttcaccgtaaagttttcgtcgtactcggcgatcagcatgggcataccaagtgtacggtgggtcttgggattgatggtaatgggtccagccgcgcctggggcgtcctttacttcggcgagggccgcggcaacggcggggccgtcataagggtcgtccacagccttcagcgcctcggccagaaccatggtggcgtcgtagccgaagcaggcgttggcaatcggatattgggcgccggtttcctccatatatttctgcacaatggcataggagggatcgtccggattctccatatccacattctggaggaaataagtatcatacacctttgtttttaccagtgtgttgaagggcgcctgaaacgtattgtttccaagcacgatcccctggtagcctgcctcgcgcagataatcgtagcacaaagcgttgtcggccgcatagttgcagatgaacacagcgtccggattggcctgcgccagcttgacggcctgcgcgcggtaatccacgtcgccggtctggaaggattcctcagccaaaacctgaccgccgttttttgtgatataatcggcgaacggttcggcgtgcatgaccgcataggaaagcccggcgttatagaaggtgccgacggttttgacgcccagcttttccatggcataagccgcgatggaatacgattgctgcgcgcagcccggctccgccaggaacatatagggatacggctcgccggtgttttcattcgtggtgcagcgttcatccataaagtggcccacaatcgggatttcgtcctctgtagacaaatccacccatgccagcgccgggttagagagcgggggaccgacgattgcggcgacgttcttttcatctaccagcaggcggtagcagttgacgccctcctgcacgtcgtttttgcagtccattgcgatcacctcgagcggacgtccgttgatgccgccctgttcgttgatgacgcgcaccgcgtattcaacaccccaggcgttggcggtgccggcctcggaagcgccgccggacaaatcctgaatggtaccgatgagaatcgcattttcatttccagcggcggattcttccccattggatccggcagcgccggcagcttgcgagggggcgtcgctctggctgtcgttaccggcggcggaacatccagccagcgcgccaaaggtgaggcagactgccagaatgcccgcgagcgttttgtttttcattgcgtgcgtcctcctttaaaaaagataatttttatttctgcatggccatcatgcgaaatgatacacatttagtaaatgttttcttaatcagcacatttgccaaattagccaaaatacaccatttgaggtcaattgcaccaattttttgtttatcatttgtaagtttctagctttattatacgattattttagaaaattgcaagctaattttcagaaaaaataagaaaaattttagaaaacgtttaccaaaatattgacttttatataccttactccctataatgaaaagcagaaaccttgagaattgttccgcaggcgggggttatttaaaagaggaattgcctgctttttcgcaaacagcccctatccttaaattgtaattgtcgggaggcacgcgcatggaaattggcgtcatcggcgcgcagagcaaacacaccgagcttttctgttccctgatcaacacctcgcccttgtttccccggatgcgggccgtttccctctggggcggcgactgccccgaacgggtcgactggtgcatggcggaaggcgggctgcaaacgctctgtgaccggcccgaagaagttatcgaacgcagtgacggcgtcatcatcacgctgcggcgcggagaaacgcacaaggcgctcgcgttggcttgcctgcgcgccggcaagccggtttttgtcgataagccgttttgcgatagcgtgccggacgccgccgcgatgatcaatctgtccaagcagtgcggcacgccgctgaccggcggttccacgctctgctttctcccacagatcgcggagcttcgcgagcgggcgcgccactgccgcagccttatcatctcctatgcggccgattgcgattcgcccttcggcggctggaacttttacggcagccatctggccgacctgtgctctgcgatctgcggctgtggagccgaaatggtttcggcgcggcgtacaggcagactcatggacgttcttgtacagtaccccaaccgaagcgttctgcttcactccgatcccacgcttactgagccggccgtgacattccacagctgggacgaggagtactgtccgctcggcgacttcgaccgctgctatgaatacggaatgcgtgcgtttcgcgacatgatggaatccggtgttggccaaggcgcgcagcgtcttttattttccacgcgcctgctggatgctatcggccgctctctgcaagaggcacggcccatcccgcttatataagagcctgtatccacagccgtaaaacgccgcccaggcgggtcttttgcccctctccacgttaaattttcttgccgggcggcagcccgcctgcaaaaattcgcattgatcgggtacaaaatccctcgcctgtccagtatcctccgactgtgaatacaggttctaagcgggataggccgcgccacagcaaaaaagcaggggcggcgcccctgctttgtaagtttcttattccgcctgcccgcgcagatcccggacgctttggcgctcgatcagaatcggctgcaggctcatatttaaattcaagctcttgctgccgtcgccaagctgatcgatcagcatcatggcggccagccgccccgtttcataggacggacagcggatcgttgtgatcggaggcataaagctctcggcaaacgggatatcgtcaaagccgacaaccgacaaatcctccgggatacgcacgccgctgcggcgcagctccgcgatgacgccaaaggccaccatgtcgttgacacagaacaccgctgtcacatccgcccggcgttccaatatctgctgcgcaacgctgcaccccgcgtccatctcatagctgccgctctctaccgcttccacaggctcgctgataaagaccagcccggcggcttcatcctgaaagccctgctccgccatttcctcgcggtagcccttgaggaccgccttacgcgtccagcgtgtcagcggggtagaggcgaacgcaatccgccggtgtcctttctccgccagatgccgcactgccatgcgcgcgcccagctcggaatcatagttgatacaggcgcactcctcgcgttcaaaccgctgatccaactgcacaaacttcatgccgcgggacagaaaatccgcgacagagctgtgctcctcgtccgccgacgagaggatcacaccctgcacctgccgggcataaagctgctctaaaaacgcgcgctcccgctcaacgctgcgggcggagttgcagagaatgatgtgataatttcggtcgtaacagaccgccgaaattccctggatggtctgcatataaaaagggtttgtaatattcggaatgaccagcccaatatcgcggcttccgccgccgcgcagcttttgagcagccgcagaaggaacataggaaagcgcctcagccgccgcgagaacccgcttgcgaagctgcgcggtaacgccatagcccgaatcccccaacacgcgcgagacagtcgccacgctcgtttgtgcaagctccgccacgtccttgatggtcgcccggcccttcttcgtgtccttctccgccatccatcccaccccttgtccaatgatcctttttattttacccgtttttaatcaaacgcgcaataccaaagcgtccaaaggctttatacggcgcgcccggcggccatcgccgcaaatctgaataaaaggagcttctcttatgaattcttcacaggaactgctggaacggatcacacgcccctcgccccgcctgatcgatgacatcgccaagatttcaggcgatatcatgattgtgggggcgggcggcaaggtggggccgagcctcgccgtcacagcccggcgcgcctgcgaggccgcgggtcttacaaagcgtattcttgccgtctcaaagcttgacgacccagccgccgcagagaccatgcgtcattggggcgtgcaggttgtagaagccgatctgctggattcgcagcagctggacgccctgccggaaatggacaacattctctttctggcgggacgaaaattcgggacctataaaaatcaggcggacacctgggcggccaacgtgctgctccccgctaaaatctgcgaacggtttccaaaagccggcatcgtcgccttctccaccggaaacatctacggcgaccgtcctgcccgctgcggcggatccgtggaaaccgacgcgcccaatccggatggcgaatatggtcagacctgtctcggccgggaacgggtgttttcctattacgccaggcgcaataaaacccgcagcctgatgttccgactcaattatgcggtcgatctgcgttatggcgttctgtacgatatcgccaaaaatgtgcgggacggtatccccatcaaactcggacgcagcgtcctcaactgcatctggcaaggggatgtctgcgaatacgccatacgtgcgctgctccacgtggacgcgccgcccgctgtcctgaatgtgaccggaccggagacattctccacgcgttgggcagccgaacgcttcggcgatctgctggggcgcgcccctctctatgaaggcgaggagcagaacggcggaattttcagtaattcatcaaaactgatggagttgatgggatatccctctgtttgcctggagcggatgatacgttggcaggcccagtggatactggacggcggctcctcaatcgccgcgcctacgcacttcgatgcggccgacggggtctattaacccgttgcgccgctttttatcagccatggacggagccggctttaagaacatgcgtccgcagtcgtccagcgccgagcagatcattctttcgcctttgctccgcgtaaaatttcccctgacctggagcgccacttacctgtccagcgtccttcggctgagaatacaggtcccaagacgccctttatcaacaaatctgatatgtaacaaagaaaggaaggattcaaatggcaaactttcacatcaagggtaaaacggccgttatcacaggagccagcggcattttgtgctccacgctcgcccgcgaactggcggcgcacggagccaaaattgcgctgctggatatcgcgtccgaacgcgccggacagcttgcccaggagattaacggcgccggtgcagaggcggtcagcttttactgcgatgtattaaaccgtgaaagcatcgagaaggcagggcaggcggtcgccaaccgttttggcggcgtggatatcctgatcaatggcgcgggcggcaataagcctgccgccacggcaagcccggaactgagcttttttgatcttccgggtgacgcgctttcctgggtgctcaacctgaatctgatgggcaccatttatccaacccaggtctttggccggttcatggccaagcaaggaagcggctgtgtcgtcaatatctcctcaatggcagccttcacgccgctgacaaacaccgtagcttacagcgccgcaaaggcggctgtctccaattttacccaatggatggccgtttacttcagtcagaattgttcgcccaaaatccgagtaaacgccattgctcctggatttttgctcacgcagcagaatgactacctgttgaaaaatccggatggaagcgacacggagcgcggccgcaaaattatttccggcacgcctatgggccgatacggcctgcctgcggagcttgcaggcgcggtgatctttctttgctctcctgccgccagctttattactggcgcggtactgcccatcgacggcggattcagcgcctattgcggcgtataaacgacataagtacagtattatggcagccggccccggattgcattgacaatccggggccggctgccgttcgcgcagacagcgtccgcttaataattttccgccttgacctggaaccagctctgcggcttttcgcagactgggcagacctggggcggctgcgcgccttcatagacgtggccgcagttgaggcagatccaggtgacgctttcctgttttttgaaaacagtcccattgtcgacattggccttcagcgtttcatagcgttccatgtgttctttttcaattttggcgaccagctcaaacagcgcggcgatctttgtaaagccctcctcacgcgcttcttttgcgaaagttggatacattgtctcgtactcataccgttccccgccggcggcctccatcagattttcgcccgtggccggcatcccgttgtgcagcagtttgaaccagatttccgcatgttctttttcgttgttggccgtctcgagaaacaggttgccgatctgttcaaagccgtccgccttcgccttcgcgccgtaaaatgtatacttattgcgcgcctgcgattcgcccgcgaacgccgccatcagattcgcttccgttttggaacccttgagaattttttgcataaccatcgtctcctttacagattagatggcattatctttcccatttttctccttgttcattcccgctttccagcctttttgaaaaaaggcccccgcttttttgaaaaaagcacggcaaaaaactgcttaccttttttgaaaaaaaggtaagccaaaaaactttattcggctgcgccgcgaacagcggggcgggttccagtatttttacaggctgcgccgcgaacagcggggcgggttccagcatttttacaggctgcgccgcaaacagaggggccggtttcagcattgatgcaggctgcgcctgtcccgtgaggcgcgccgccgcggcttatccgcgcccggcgctatagcgccggattgccaagacgcaaaatttcacgtaccattccaatcctctcccatcccggcaagaatcgttttcagaatatctgctctgcgcgctccaatcagcgtgcggggcgggttttgtttactccttttcggcagcctttttctgtgcggctgcctccaaaatatcctcaagattgtccaaaacaaactgctgtgccgcacggttaaagagattcaccagataggtatctccccgttcatttttgcgctcctcgcgcgagatgccaagctgaacgcctgcttgcgtcggcacacgggtgcggcttgcttcgggcttttccaaaaagcccatctcctccaggccgtcggcaacctttgcgaatgtgagctgtgtatcgctggtcagaaccgtgacattattaatttgttttacaaacccggtcaaaggaatcggttcgtcgagcacgcgcacgcgcgttttttgctcgggcgtaatcgaaaacggcggctttcttggcgctttgcgccggccgaccgtcccgccgttttcgatgacctgctccagaatgccggatacataagcaaagcaacgcgacaaccggacattgcttaacacgccgtcaagtggaagcgccgaaccgctgatcggatcgattcctctcgacagcttgtccagatacatctttgcacgtttcatcgtatcaagctcgttcatacagcttccacctcttaaattccccaaaattgtactatattcctatttttgcagcttgttggaaatcagtttcattataccattgcttcctgcaaaagacaattgccgccaattgccgcattgcgctgattatttttaacagcacacaaaaaacaggcgtgctgtataaaaaaagaacacaggcaagctgtgttctttaagacaatctattgcatcctgtttctcaatacaaaatgaactgaactccacaaaagaatactatacgtaatcaggccggtaatgagatatcttatatttgcgtgccttttattctcacggtcccggaaaaattcaaaaaatgtccagccaatcatcatcagccatccgcacgtagtcataaccaaagcaggcgttccacggatcgacggccaaaagtgggacagagccaacagtaccgcggccgccttatagatataggagaatgcttttcctttcggctgtaagttcaaagctctatcgattcactcccttgcaggcgcatcggatatgacccctcataatactcatggaaggtgcctaaataggtcgttttcccattgctcacggcatatgccttaaccgtataatgcgattggaaataggcgaaggtgccatctgaataatgcgcttctctatactccttttgaaccgtgccatatgtataacagtccggccaggcaatcgcaattgcagataaagcgccggaaatttccccgccaattgatcgcgcggcactcggcggcaaacaaaaagatattgcccctgttattgtgctggtggctgaagctagcgattttatgtcggtgctccagctctcattcccatttccaaaccaagggccatacgtgataccgcttgcccgtgtatctgcatcaaatgattctgtgggttctccgggagcagcagcgaacacacttccggtcataaaggcggtaatcatgacaagtacaataagacccgaaataagctttttcattttacctctccttcttttcatgtcggttgcctgctttgatgcgtctttattgtatcctttattttcctgtttgtcaattattttctaaaatttgttttaattgttaattataacagttatctatacacaaatcaaaatagaatcatgtgctgaatttactattccagattctggattggcattttttgaatcagcgcgcgtgggatatttttttatggaaagtgaacactaacacagcatatgaatcttgaaacgagggatgaaacctatgaatatgacaccggaggaatacaacgaacttacaaaacaaagctccccgcgatcgccgttcatcaaggactttcttttggcgttcactatcggaggactgatctgcgcgctcggacaggcgattatgatggcataccagtcgtctggtatgaccgaggaggtttccggcagcgtcacttccgtaacgctggtccttctgtcgatcatattaaccggcttcaatatatatccgaaaatcgccaaattcggcggcgcgggtacgcttgtgccgatcaccggctttgcaaacgctgtggcctcgccggcgctggaattcaaaagcgaaggtctggtgcttggtctggcggcaaaaatgtttgtaatcgccggcccggtcatcgtctacggcaccagtgccagtatcgtatacggactgattatttacctgttcggactgtattgaggaggggcgtttatggcaaagcgtaaaggaacctataccgttgtgtttgacgaaccaatcagcgtgcgcgcctctgcggccgtcggctccaaaaaggaatcggaaggaccgattggccacgcgtttgatgtgatcaatgaggacgactactttggcgaaaaaacatgggaaaaagccgaaagccgtatgcagcagaccgcgatccaaacggcgcttgacaaagcaaagtaccagccttccgacattgactgcgtgttcgcgggcgatttgatgaaccaatgcgtcggctcaacatatggcctgcgctcctttggcatcccgttcgtgggattgttcggggcctgctccaccatggcggaaagcctgatgactgcatctgtttttcttgacagcggcgcggcgggccgggcggtcgcatgtacctcgtcgcatttctgtacggctgaacggcagttccgcctgccgcttgaatacggcggccagcgcacgccgaccgcgcaatggaccgcgaccgccgcaggtgcggctgtccttgaaaaaggcgatacaccgccgtttatccatgcggctacgatcggcaccattgaggatctcggaatcacggacgccaacaacatgggggcggccatggctccggccgcggccgcgacgatcaagcggtttttcgacgataccggcacaaaacctaatgattacgaccttgtaatcaccggcgaccttggcaaagtgggcggcaccatcctgcgcgacctgctgcggcgggacggctacgaccttgaacactgccagaccgactgcggactgatgctgtacgaccttgaaaaacaggatgtacacgccggtgcaagcggctgcggatgcagtgcttccgtcatgtgcggacatatcctgccgctgatgcacaccggccaactgcacgatatcctgtttatcgcaaccggcgcgctgatgaacacaactgtggtacagcagggcgagagcatcgcctcgattgcgcatctcgtttatctttcgtcaaaaaagaagggagggcttgtttcatgaccattctgatcgcgctgctcaaagcgtttcttgtcggcggactgatctgcgccatcggccaaatcttcatcgattatacaaagctgacgcccgcgcgtatcctgaccggctatgtcgtcgcaggcgtgattctcggcggcgtcggcctttaccccaagcttgtcgaattcgccggcgccggcgcgacggttcctctgctcggctttggcaacacgctcgccaaaggcgtgcgcgaggccatccaggaggagggcctgctcggcgtattgaccggcggacttggcgccacagccgccgggatcgctgccgccatctttttctctctgatcatggccctgatctttaaacccaaaagcaaaaactgatgctaaggcgcgcgcagcccatgcgcgggccgctcaccgccgggcgcttcgcttgcccggtcggctatgcggtgctttccggcggctacaacgccgggcgcgtccaagcggcgactgcgcccctttccacgcctcacaaggggagtgtcgcccgacactccccttgtgttgttatccccaccactgtttggcacggatttttcgggcgcacgcctgtacgttctgcggtaaaccgtcaagccgcgcccgccccggggttgggttcatagggtaggggcggccgggccgccccgctctttacggcacaaccggtagaattccaaaacccgccctactgttcgcggcgcagccggctaaagttttttgccaagctttttttcaaaaaagcgggaaagctgttcataggcgggcgctgggacgcccagttcgtgcgcgatgcgcgccggctcaaagataagtccgtcaatctcgctgctgccgccctttttaagatccttctgcatcgacgcggtcgcgtcaggggaaagcgcgtcaagacgccggagcgaattttcaaccatatcgtcagggaatctgtatccacgcttatccgcaatggcttggagttcgcggataagctcaataaacaggtcatggccttttcccggcgcggccagctcgccggcggtcatatcataataagcgccggccgcagccagtggagatacaaacatgaacttgcgaaacgcgtcgcggcggatgtcgtccgaaacgacaacatcgatgcttgcgtcacgcagctcgccggcaattttattgagacgcccgtccggctcatctgtatcgcgctgcccataaacgatgcgaaacagatcgccggtctgcgtgacttctcccggaccgctgatatatgcgccgatataaatgcagccgtcgagcaccaggcgtccaggcaggcgcggtgcaagccgttcgcctgtgccgacgatattaagcaccggaatgacaacgctgcccgcgtcggccgcccggtcgatcagcggcacgacttcatcgattgaatatcccttgacacaaacaaatatcacatcagcacggccggtaaattcatcggccgtgcacgcctttggatggatgcacagctcgccgccgcggcgcgtattatacaggcgcagccctctggaacggattgcttccagatgcctgccgcgcgcgatcagcgttacgtcaaatcccgcgtccgccagataaccgccgatgcagcctcccacgccgccggccccaatcaccagatatgtcatgcagattgcccctttcccgctatttcagatcttgcagccggcgcatagcaagctgtgcgtcgagcatcccggatttatacaagctttcaagacgccgcaaatccttttcaaaccggctgatttcaacgggccgcgacggcgcgatgacggcagccgtaccatcgcgctcgagccgccgtataaaatcaagcgtttcattataaatttcatggcggcggtcgagcgcgcgcgccaactgcggatactcgcgaaacatccggtgatacagcgtccgaaaatgctcgggcgctttttgataggaccggtcgcgcgtgagcacaatgacaaggcggccgcatccatcggcaagcgcgcggcggaccgggatcgggtcgcttgtcccgccgtccagatagcggcctccgcgaaacgacacaaccggcgaaaagcccgggattgacgacgaagcccgccacagcgtgctgtcgcccggcgaaacggccgatttgtcgaagtaaacaggcatacctgtttcaatatcggttactcctgtaaccatttcaataggcgaggctaaaaacgccttatagtcgaaagggtcaaggcggttcgggatttcatcaaaaataaaatccatcccaaacatggattttgttttgatgaagctgtccagcccaacataccgcttatcacttaaatatccagtattgatacggtagctgcgtccgcgctggccggagatatacgacacggcgctgcacgcgccggccgacacgccgattacataatccggataccagtcgttgtccatcatacagtcaagcacgccgttcgtatacaggccgcgcataccgccgccctccaggacaaggccaatcttcatgcagggacctcttttctgaatttaaaagcagattgcggacgcctcaaagcaaatcaagctccacggggcagtgatcgctgcccatcacatccgcgcggatacggctgtcatgaaccgcgccgcgcaggcgttcggagactataaaataatcgatgcgccagcccgcgtttgtatcgcgcgcgcggcgcagatacgaccaccaggtatatgcgccagtcacgtcgggataaagcgcccggaaggtatccacaaaaccgcccgcgagcagctcggtcattttggcgcgttcctcgtcggaaaatccggcgttgcggcggtttgttttcggatttttcaggtcgatctcctggtgcgcgacattcaggtcgccgcacagcaccaccggctttttcgcgtcgagcgacagaagataagcgcgaaaatcatcctcccacttcatccgatactccagccgcgccagctcacgctgcgcattgggcgtatagcagttgacaagataaaacggttcgtattccacagtgatcacgcgtccctcactgtcatgctccgccataccgatgccataagttacattcagcggcggcacacgcgtaaaaacagccgtgccggaatacccttttttttcggcgctgttccagaactgctgatagccgggcagctccagatcggcctgttcctggtgcatcttggtctcctgaaggcagacagcgtccgcgtccgccgcgctgaaaaagtcgaggaatcccttccccaaacaggcccgcaggccgttaacattccatgaaaccagcttcataagctcctcccgggactgacatcccctgtatcttattttgccccgcgccgttgacgtacagacgcatccgcgttatgatgagactgcttatatataagcgatcgggggatttgatcatgaaaataaccgaagtatcaggcgaccgatgggcgtaccgcgacctgcttttgctcgccgatccgtccgaagaaatggtcggccgctatctgccggacggctttctgctggccgctcatgaaggcggcgcagccgtcggtgtcctgtccgccgtgcccgtcgaaagcggctgggagctgaaaaacatcgcggtcgcgccggcattccagcggcgcggcgtcggacgcgcgctgatcgacgccgcgttcgcgcgcctgcccgccggcacgcgcgtgctggtcggcacgggcgaaacgcccgcatccttcgcgttttacagcgcgtgcggctttacgctgtcccaccgcgtgaaaaatttctttaccgacaactaccctcagcccatatgggacgacggcgtcctgctgaccgacatggtctattttgtccggcttttttgaaaaaagcctcggcaaaaaacttcttaccttttttaaaaaaaaggtaagccaaaaaactttaatcggctgcgcccccgcttttttgaaaaaaagcttggcaaaaaactttagtcggctgcgccgcgaacagtggggcgggcgctgcgttgatacaggctgcgccgcaaactgcggggcgggcgctgcgttgatacaggctgcgccgcaaactgcggggcgggcgctgcgcgtatacaggctgcgcctgccccggggttggggccatgggataggggcggcccgcccctgtcccgtgaggcgcgaaaaggggcgcagccgcggcttgtccgcgcccggcgctatagcgcgcttccaatctttaatcaaagacgatccagcttcgtttcctttgctggtttcgctgtacgtccatccttcgatggatgcactcaatttcgtttccagggtcctctgctccccctccggaccctttcaggccctcccgggttcgcttcggttctttccttctcgttgttcatttttcaaggtgctgcttgtccccggcctgcgggcgtcaccctcaagcgggagtttcagtctatcatgaattttcggcaaagtcaagcggtttttacaaaaaaatttaaaaaattttacctgcatgatttttcaacatgttttcaacctttaaacacgccttttcaagctggtttccaacaatctcaacaatttcatgttgaaaacaatttttccgcttttcgcctgcgtctctatcttgcccatacgaaaaagaaaaaattcacaaaattgattgcaatccgtacaaattatgttatactatataggcatcagcttttactccttgagaattgctgtgacttatgcgcccgtagctcagctggatagagcgttagactccgactctaaaggccgtgcgttcgaatcgcatcgggcgtaccaatctggaagctgcactttagcctttgaaaagagactaaagtgcagtttctcttttaccttgaccagcctacaatttttatctataattttatcaagagttcattattctgatcgattctctgggaggtcgtcgtgacaaaggaacaggctattgcggaattttttcaatataatcaaatcgatccggcgcaaatttccagatatctcgatccgaagctcgagtatctttccgaaaaagtagaccagtggctgaccattgtcgatccacctgaccgggagttatttctgcgcctgttgagccgatatacttatctgaccaacgaagcttctgtccggcggtatcatgagggtatccacatcttgacggacacgctgcaatccttgggtctctccctttgtgatttgttatttatttcaacagaatcatcagacaagtggaaagcgggaagcgatcatgtccgcacggatttgcaccgtctatgcatggggcgaatagacgcccgccagatcgtcgcttgcacacgtaagctgtctgcagaggaactggccggctaccgcggttttgtctttgtggatgatattgttggcactggcttcactctgcttcggacaattttatcttttttgaatcaatttgcggatattattaattccccgctttttgtgctttgtatcgtcccgacggacgcgggtctctcctatcttatcggtcagttgaaaaaaagaggcgtcaatattaacctgatttataatcaggagtggatcgccgtcccggcatttcagcgcacggatatcttcgcaatttctgagcgcgccgacgctatagcgcggatccgcaaatacgaagttctgatcgacgcatacatgaaagaaccaaataaatcatatatattgggcttttggggatgcagacagcttgtatcattttactataatacccctaataacacattatgtacattttggcgctggactgatacgcatacgccgctgtttcctcgggaaaagcagcctcaaattcagttaaagcacttgcaatcggtgaagcgaaaaaaggacagcaatgcgtacaaaatcaaagctgagcaaagggcgaaggcaaaatggacctaatcgattattttgatcgtcagttgttgggttatctgcgcgcacatcccaatatgctgtttcgcgatgcggcccgggcattgggcgcccatacaatagcggtagaccatcgtatccaaaagctcatgtcgctggggttcctttctatggaacgccagggaacttttcgtctgactgaccgggctttgacaatctgcacttcgttctcaacgccaatagatgaggccccgatttcttcagagttttcttggacggacctttatattccgctaaacctcacattagaataaaaccgggaacgatcagaccggggtgaattcgcccccttgatcaaacggcactaaccactgtttgacgtgcgtgcgtcttgttcatttcattctctgcgacgcacgcacgtcaaacagacagatccattacttttacaatttatttagtgatcgttcccggttttagatatattattgatgaaacgatggggtttttaatggagccaaatgattatgtaaatcggctgcgtcatgcgatggagatctctgaaactccccgattttcaaccgattatattgcacagtgctgtacctacgcggaaaatctgctcaaacagggactgcccgtcctatttgaccaaacacatatccgaaaggtgcttggcatggccgctccccgcctgtgcgattaccacaggttcaccattcccaaacacaatgggagccggatcatcacggctcccagccgcaaactgaagctccgtcagcagtggatctatcagaatatcttgatccgaaaagaagcttccccgtatacccacggctttgtgcctgagcggtctattgtgacgaatgccatccttcatatcgggtatgcatacacatactgcgtagatatcacagacttttttccatccattacgaaaaaacaggtcctgccgatctttcggaacatggggtacagcggatccgccgccaataccctgtgtgatttatgctgttgcgatggcgtactccctcagggcgctcccaccagtccatatctttcgaatatgatctgccgcgatctcgatgatgagcttggcgcaatggcgcggcgcttccgtggcatattcactcgttatgcggatgatatcgcgatctccgcaaatcagcagcagccccagcttctggacgcgctgggattgatcttgggcaaacatggcttttcgatgaatcttgataaatgcagaatatacaatcctggacagccaaaacgcattaccggcctgactgtacataatcgtgtcagcgtgccaaaggcttttaagcgtaaattgcggcaggaaatccactattgccaaaagttcggagtcactgcccatttggaaaacacaaaggcggcacgctctatacattaccgggagcatctttatggaaaagcatactatgtcaaaatggtagaacctgaattgggggcgcattttttagacgagttatccaaggtggattggcccgagtgaccatttgttactgttgcaggcatggctcgcatcgtttggggaaaatccatggttaaagattccggtatcgttcaaagatgtctaaggagaatttatcttccttgtattataaagctgacatttcagtgcgtgtggattgagaaatccacgcgcgctcctctttttaccctgttctattgctgtgaatgcgggcgctggtttttatatacaaattgtttgttcaccatttgttcatctctacaaaatagatcgttgatatatatttttttgcgtagccgcttgacgaacgaacatccataatttagaataaagaagaccggtcaagtaggaaattttccagaggaataagtgaggagggtttacggcgaatgattacattttttgtttgcctggctttactgattgtcggtttctttacctatggaaaactggtggagcgcgtattccatattgacgaccggcagacgccggctcttgcgcatcccgacggtgtcgattatgttccgatgaaaacttggcgtattttcctgattcagcttttgaatatcgcggggcttgggcctatctatggcgccttggccggcgcctgctggggtccgcaggtctacctgtggattgtgtttggcaccatcctaggcggcggcgtgcacgatttcctttcaggcatgatgtccgaacgccatgacggcgcttctatctcggaaattgtcggcacatacatgggcaaggtcatttcttttattatgcgtgttttttccgttgtcttgcttttgttggtcggcatcaacttctcggtcggtccggccgcgctcatcggcatgctgactcccgaggtcctgaacacatcgttctggctggctgttatcatgatttattacctgctggctaccttcctgccaatcgataaaattatcggcaagatttatccgatctttggaatttgcctgatcatcatggccgccggcatcgcggggactctccttctgaacccggcatattccagccagatgcccgagctatggaattcgcttgcggtcgttcaccccaccggcctgccaaaatgggccatgatgtttgtcaccgtcgcctgcggcgcgatctccggctttcatgccacccagtctccgatgatggcgcgctgcatgacttccgaaaaggaaggccgcaaggtcttttacggcgcgatggttgctgaaggcatcatcgctctgatctgggcctgcgcgggcgtcaccttctacaatggcgtcggcccgctctcagaagccatcagcgcccttgggcagggcacggttgtttacaatatttccaccaccctgatgggtccggtcggcggcgtgctcgctatgatcggcgtcatcgcctgtccgatcacatcaggcgacacggcgtttcgttcctgccgtctgaccattgccgactggttccgcatcgaccagtccaagacttcctaccgcgccgctctttccatccccctgttggcaatcggcgcattcaccgccgtcgcccttccctttgatattctgtggcgctacttctcctggtccaatcagacgctcgcaatggtagttctttggacaggcgctgtatttcttcataagttcggcttcccgccggtgtgctgctttatggccgcgctgcccgccgctttcatgtccgcggtcagcatgacctatatccttcaggctcctgaaggcttccggctcgccacctccatcgcctatcctgtgggtattgttttcgcgctcgcatgtctggctctctttatcttccagacctatgtccgaagcggcaaaacggcgcagcccacagcgcagggcaactcctgatagcactgtttcaaacataataagccgtacggcgcgcatggtgaggtccatgcgcgccgtgcggcttttctctggggcgtctgaatcggcaaccggccgcagcctgattttgacacggaaactttctctgaaacggttgatttcctcttgcggatatagtacccttttaataaatactccaacaaagtttgcaggtgaatctaattatgcatctaaagcgactggccgctctggtggcggccgtctgtaccctgtgggcattgcccgcgtccgtcctggccgcgcaaacgcctggcggtctggatatcgatcaaacaggcgatcttgttgacggcagctatgtataccgttcgtctgtaacgcttacgctcttgccggagcatccgcaggacaccttgctcatcgaggacggcggcgtctggatggagctgacgccggataaggagcaaaattatacgctcacctttcgccagccgcgggaatataagcttcgtttttgtacccaggcgccggacggcacgcgcggcgaacctcgtgcggaaagctttacaatcgatcctgtgcttgcgcagctgatcgacgacagccgcgcgctcccgaacctgttcacggcgaccgacagcgaggtggaggcgcagcgtgaaaaaatcatggacgttcaatcccgctggagcgatttgactgaaagtcagcgcgcactgttccctgtctcagaacagcatcgcctgacaaagcttgtcggctggttgagcaatatgcagccggccatcgacgtgctcgcgccggatacgcccacagtcgttttgaccggagcaaaggcgccgaataccaatatattttccggcaaggtcgatgttgaagtacgccctgcgacgctctatgatttggagcttgtctgcattcgtgaaaacgatggatggcaatatatagaaccgacggacggcgtgtacacagtatcgtttacaaatcccggcggctatgcgtttgatgtttgtgtacgcgacgccgcaggcaatcacagtccggcccggcgcgtcgcctttacaatctccgatgaactttgcacgtttttaacaaggatttccactgctgccggcgcggacgcggaagctgcgctgattgaatattatgcgatgtccgccgcgctgcgcgcgcaggtggatgctcaggtgatcgagcggctgcaaacgctctgcggatggcaatatgatgcgtataacctcggctggcaggcgtccgccggagagcgccctgtacgtgccgtcggcatgcttggcgcgttcccgcagggcggcgtccgattttccgtgaccggcgcgccaagcaatcagtccctgcccaatgtttccaaacagacgctgtacgcttattctatcgcttttacaaacgcggacggcgccgccgctgtgccgcaggctcctattttgatccgcgcggtgcttccgcagtctctgcttggaaagaaaggcgtccaaatatatgatgatacgggcgcgccgctggagacgcgtgtaaaaaacgaggacgaagggatcacgcttgaatttacgatcgcgcgcgcgggcgcttattatatgacggcggatgggtgaagcatctccaaggcgctgaaagggccggttccaattggaaccggccctttcagcgccttgggggcaaggggcgcggccgggggcctgcctgcggcgcaggcaggcctcagacaaacgccgggcggcgtttgtctgtcctgcgcgcattcgcgcgcaggcccggccgcgccgccccctcccccatacttttaaagcgcaggggtatcgcataccgtttcattcgaaacctgcctggagtcctttactctgtttcggcgcgaccgccacagcaggccgcagccaatcagcatcagcaaaatctgtgcgaccggcagagaaatccacacgccatccatcccgatcatgcgcgggaacacaaaagccagcagcagcgcaagcaaaaccgcctctccataaaccatcacatatgcgggccggttgtgctgcgtcgcataaaaatatgcggttgttacacggcagaacgcaatcgggataaaaccgactgtaaagacaggcatcgccttggccgccatcgcggccgcttcgcctgaggcgccgaaaaacacaggaatcgccacgcgcaaaagacaaagtgcagcgatattggcaacagctgtcaccgctgcgaaaccatacgcaagattacgcaccgcctttgtccgttccggccggtccataccaaaatacaggctcatctgcggctggcttccatcacccaccccttgcagcagaagcataacgacagccgttgcataagaaattacggcgtacgcggctacggatgattctccgccatagacagacgccgccttattaagaagcataattacaaagagcggcgacattgcaagcccaaacggagaaacggctgtgcgcagaatcgagccgcacatatgtccggccggcctgaccggaccgcttccaatccggaaggtcacgcgccacagataaaaagcgcatggaaccgccgtgacaatctgcccaatgaccgtggctccggccgcgccggccatcccccacccgaatacagaaacaaacagcgcatcgagtacgatatttgtgacaaacccagcgatcattgcgcccatagctgcaagcgcgccatcgtaatttcgaatcagcggcgcaagcgcggtagcggcaagctggaacggtatacccagcagaatcacacggagataaacaatcgcctgttcgagcacttcaccgcgcgcaccaagggcagcgagcgccggcgtgccgaatgaaaaaagactcaccgcaagcagaacgccggcagccgccagcagcaaaaacgcccctcccagatgtccgcgttcgccgcgcgtatcgccgcggccgcggcagacggaaatacagaccgccgcgcccataccaatgcctgtaccggctgcctgaagcagcgcggacagcggataggcgatattgacagcggccagccccacgtcgccaacactgcggccgataaaaaagccgtccacgatcgtataaagtcccgaaaatgcgaaagcagccatcgcgggcagcacttgtttaaaaaattgcttgaccatgacaaactccctgttttctgttagaataaagatagtataaaccttaaagctgcttaaatgtcaagaccctcggccggcatccgatcaatcgtatctttcaaatttgtgaatgcccaatgacagaaggtggatatatgataagaacctttgatttcatactcaaggcaaaatataacaaggcttttatggaacagcttgaaaaagccatgtcgagcgatcagagcagtgaactctgcacggatacgcacaggctgacgttttatcctcagtcaaaactgattctcattgcgcctgcatcagacagcagtgtttttcacaataaaattgttccgaaaaagatgacctatcaggcgttttttaaaatattgcatgggaactgggaacagttggacgccgatgacgtaactgatccataaaaacccgcatactctcattcgccgttttattcaggagccatcggctgaccttttaaaaaataggtcagccgatggcttaggagcgtttgataatcatgcgcctgtccgcaaagcagtcaatgtgcacaaaaacatctgttatgccgctgttttcaaaaacaccgctatcttggaggtctatgatgaaaaaagacgattgtatcgccgctgtggcgcggctgtttggtgtcgcgccgtcggcgctgcgctattgggaccgcatcggacttgtccggtttgagcgtgacgagcagaataactaccgccgcccctgtgctcagacaatgctggacatctccaatgttctgctgttccggcagctatccattcctctgcgcgatatacgatcgctgccggatatggacgccagccgtctcgacgccctgctcgcagaaaatgaacaaaagctttccgcacaaattcacgaacttgaaaacgctatcgaacatatccgtgtgatgcgcggcgcaatagcacgcctggaccatctgcgcacaagtgcgattacactggtaagcgaccagcttccggcaatccgtccgttttcttttgaggatgagtccagcgtacaaacatatgtttacgatgtgcacgaatcaggcatcgtaatcccgcaaggcagcccgccgtcttatggaatcttctgccctttggaccttggcccgcgttctgatacgctcaagcagcgggacggcgcgccgcgcaattatctgtatggactgctgcgcgtcctgtcggacgacccgtcgcaaaacagcgcggctgattttacctcggccgcacaagcaatggggtatccggctggtccgttgtatggacggtttattgtctcagcgcatgagaaaggcgcgctgtacgactattatgaagcgtggctcgaaatcggaaagcgcgcttgtgattaaacgtcaaatatgatacaattatcaccagatggttatgatttcctttattgttatatatctgtttattgtttgtcaggcaaccgcttttagcggatgaattcagaaaaaggagcggtcatatgaagtttcagtattatattccaacgcgtatcctctttggcaaagggcagttaaacgccctgcacacacagcagctcccgggcaaaaaggctctgatcgtgacaaccggggggcagtcagtcaagaaattcggttatctctcacgtgtcgggcaagagcttgaccgcgcgggcgtcagccatattttatttgacaaaatcctgccgaacccagttaaagaacatgtcatggagggcgccgcgctcgccaaatcatcaggctgcgattttgtcgtcgggctgggcggcggcagcgcaatcgattccgccaaggccatcgctatcatggccgccaacagcggcgactactgggattatataaatggcggcagcggcaagggcctgcctgtgccgaacgatcccctgcctgtcgtcgcgattacaacgacggccggtacgggtaccgaggcagatccatggaccgttatcacaaaaacagagacaaatgaaaagatcggcggcggctatgacaagacattccccgtgctcgcggttgtcgatcccgaactgatgaccacggttccgccgcgcctgaccgcctatcagggctttgatgcgctgttccacagcacggagggctatctcaacaacaccgcctatgtgatgagcgatctttacgcgcttgaagcgatccgtttgatcggcaaaagtctggaaatagctgtcaaagacggttccaatctggatgcgcgcgccgacgtagcgttggccaacacgcttgccggcatggtggaatcaacctctggatgcacctccgagcacagctttgcacatgcgctcagcgccttccatccgcagtttgaacacggcgcggcgctcatttccgtgagctgcgcctattacagtcattgggcgaaaagcggctgctgtgacgaacgcatggtgcgtatggcgcgcgcccttggaaaaacagacgcctcccaaccgtccgattttgtcgacgcgctggccgcgctgcaaaaagcgtgcggcgtcgacgatatccgtatgagcgcctacggcgtacagcgcgaacatctggagcagtacgttcaaaacgcgcgcgccaccatgggcgggctttacgcagtcgatcccgcgccgctttccgacgatgacgtgcgcgcgatcttcgaagcctcctatcgctgatcatgtgcaaaacagaccgccggggccggcatagagccggtcccggcggcttggggccaagggcgcgccgcttgcgcggcgcgcccttggctgtttgcgggccgcgccatgcggcgcggcccgcaggcatacgaacgctcaggcgagccagcatgggcgcagcgcccgcatactggtattgacgagatcagcgtaatacacaagacagtcgggcgaattttgtgcaaggcgcagcgtgcgcgcatcaaccacaagcagattgtgattgaagccgccgctgccggaccgcacctgcaccagatcgccgacacgcagggacgccgcagttgggacaatcatcgcgccaaaatcaccgccgcgcattgcatagtcccagaacttcccgacattttcccatgcgggcgaaccgccccccgccccggcaaaccactcgtccgtcatcgccgcgccgccctgcgggctgtcgccgccgccaaagccggcgcggatacattgagaggtgaaattggcgcagtttccgagccagtcgccgatatcataatacgcgggattgggcggctgcatccatcgggcggcataggccgccgctgctttcccatcatacagcgccgcgcccgccggcgcccccggcgccgtatccgccgccagatgtgcgaattccatgcgcaggcgttccatcgccgtccggttcgacggcacagccggcgcggcccctccgaaccgccgcgaagcgcccggatactcgtgcagcgtcaccttccagccgccgctgtcccggcgcaggcgcaccgtatgctgcgcatttaccgccagcatcggcggatatgcctgcccggcttcgcctgttattataaaatgaaggtccatctccccttctccgggcgcgccgagcgtctccatccgcggatccttcaactcgctttcatcaatccatacaatcgtgtatggcagcgccctgaccggcacataacaaagatggctgttcatcaaaagccgcctgcgctggatcagcagccgcagccagagcagttcgtttttgaccgcgcggctctctgcgtccgccaccgccgacagatcgagcggctccatcgtcagatacgattcatactgcccttccaggtaagcccgtactgccgcctgcggatcaagcggtccgtccgtttgataaacgcgcgcgccggtcaaacagccctgccgcaagccggccgcagtctgttcgcgcaccggctgcgctggaatcccgcgggcaatcgcgcaggccgctgcaagcgccgccgcaatgactgccaagcgtcctttccccatccgctcacctcctgttttatctatatgcgcatatggggccatcttttccgtgcggttagaagcgtaccggcgcgccctggagattttttctgtgaggccattgcatccctttctggaacatgatacaatatatagcgttcgcatagtgcaaggaataccagatcatgttggaggaacagataatgaaaattggaaaaaacgcgctgaccgttttggagcggcgttatttgaaaaaggatgaacacggcgaaaatatcgaaacggtcgagcagatgttccggcgcgtcgccgatgcaatcgcttcggctgacgccgcttacagcggcaaggccggcgttgcggcactgtcgaaccgattttatgagatgatgacaaatctggagtttttgccgaactccccgaccttgatgaacgccggcaaggagcttggccagctttccgcctgttttgtgctgccagtgggcgattcgatggaggaaatcttcgaagccatcaagcaggcggccttaatccacaaatcgggcggcgggacaggcttttcattttcgcgccttcgcgcagccggcgcgaccgtgcgcagcacgggcggcgtggccagcggtccggtcagctttatgcgcgtgttcaacatggccaccgaagccgtcaaacagggaggcacgcggcgcggcgcaaacatgggcatcctgcgcatcgatcatcccgatatcctggagtttatcgactgcaagaaaaacaacgccgacatcaccaatttcaacatctcggtcggcatcaccgaggagtttatgcaggcggtccagcagggcaacgcttatgaacttgtcgatcccaaaacaaagcgggccgtcggccggctcgacgcgcgcgaggtctttgacaaaattgtggaaagcgcatggcgcaacggcgaacccggcattatttttcttgatcggctcaaccgcgacaacgtcgtgccttcacagggcgagatcgaaagcaccaatccctgcggcgagcagcccctgcttccgtacgagtcgtgcaacctcggctcgatcaaccttgtcaatatgctcaaatatgaaaacggcgcatacgccgtcgattatgacaagctcggccgcaccgtgcgcgacgcagtgcattttctcgacaatgtgatcgacgtcaacaaatatccgcttgaggaaattgacgttacaaccaaacagacccgtaaaatcgggcttggcgtgatgggctggtccgatatgctcgcttatctgggcgtaccttacaattccgacgaggccgtcgcgctcgcccgccgcgttatggagttcatcaccaaaaccggccgcgcagaatcagccgagcttgccaaagtgcgcggcgcgtttccactgtttgaaaagagtatctatgcgggcggaacgccgcttcgcaacgcgaccgtcaccacgattgcgccgaccggcacgctttccatcatcgccggctgctcctcgggtgtcgaaccggtattcgcctatgtctttatccgcaacgttatggacggcaccgaaatgatcgaagtcaaccccgtcctcaaggagatcctggaggcgcgcggcctgtacagcgacgggctgatgaaaaagatcgccgccgaaggctcgctgcagcatatcgaggaaattccggccgacatccgccgtgtatttgtctgctcgcacgacgtaagcccgctttatcacaccaagatgcaggccgcgttccagcagttcaccgacaacgctgtgtccaagaccgtcaactttaagcacgacgccaccattgaagacgtgcgcgaagtctatatgctttcctatgagcttggctgcaagggcgtcacgatctaccgcgacggcagccgcgacagccaggtgctcaacatcggttccgtcaaaaaggagggcggcgcccctgccaaagccgaacagccagccggttttggtcaaatcaagccgcgcccgcgtccggaggtcacctgcgggctgacggaacgcatgaaaatcggctgcggcaacctctatgtgacggtcaactacgacgagcagggtatctgcgaggtattcacctcgaccggcaaggcgggcggctgcccgtcgcagtcggaggcgacggcgcggctcgcgtcgattgcgctgcgttccggcgtgtctatcgacgaaatcctcgaccagctccgcggcatccgctgtccttcgaccattcgtcacgcgggtatgaagtgcacctcctgcccggacgcgatcgcgcgcgtcatcaaaaagacggccgacatgatcgcgctccagcagggcctgcctgttgccgcgccgaatgcgccgtgcgcatcctgtgcggcggaagcgccagaaacgaccgagcacggttcgaagttctgccctgaatgcggaagcgcgctcgagcatgagggcggctgtgtgagctgccgcagctgcggatattcgaaatgcaactgacaaaaaaatgcccctgccaaaacagctttttggcaggggcattctctgccctcccgctatagacaaagcgccgttgtccttgtaaaaggggctggtttttcgataaaaatcctgctacaatcaggatggggaatttgcagcattcggatggatctttccccgctttggccaaacgaaaaaggaggcaaacagcttgtgaaacgctttctgtcggttctgttccttcttacgctgaccgttgccggcgcggcgtgcggcggcgtttccatacatacgcacagcagcgcctctccggcgcctgtgcaaagcggcaccggagaaactgacacgtccacagcgccgcaggtgcagactgtctccattgaattccccgcatataccgaacccaaccctgcgcagcttcccgctgtcgagcgaatcaattccgccgcaaagtttcaggtggagctggcgctccccgcaggctggacagtcggccaaacgccgcccaaggatgtggtccccatccccggtgatttttatacgccgctctccatttgcagcggggacgaacccattggctatatcggctttaatgtttttgaacctttcgacggcgatatcccgcaggcggagtattataaggcggtttaccccggcctgcgcctttcttcctttttccactgggatccatatacggcggtcaaagccaccgatacggcggaaaccggcgtggcggaaatctggtatctcgatcccaatgaaatagacaagcaccctggcgcgatgccggacgtcccccatctggaaacgtatggcgtgctttcttacgacaagcggctgcgcgtttatatcgggattgcatttgtgccggacatcctggaccgcgcgcaggtacaggcaatcgccgaaagcgtcacactgtctccgattggataaacacacttgcagttccacaaactccaaacttatgaaaggcggtgcggcacatgaatgtcagggagattgcaaagcttgcgaatgtttccattgcgacggtgtcacgtgtgatcaaccgcccggaggtcgtccagccggaaacgcgcgcacatgttctttcggtgatgcgcgcccacaattacaaccccgccgcacgcggagccgccgcgcggaccggctctatctgcctgctggccgagcacgccggcgattatcttatacaacgcctgctctttggggtggaaagtgtggccgcacggcgggattgttccgtttacctgtgcggcacgggcggccgcccggaggacgaactgctgcgcgcggcaatcgggcagcggttcgacggcctgattatctgctcctcctcgctcggtgcggaaagcgcggcgcgccttgtaaacgcgcatatgccatttgttcttgcggaacgctgccctgcggccgcgcattttaacgcctgctacgtcaatttcgaggaaggcgcctatcgcatggcgcgccatcttctggagcttggcagaaaacgcctgtggcttttgacaaacgagcaccggcccaatgtcgcggccagtatgcaggaggggctgctgcgggcgcagcgcgcagccggtcttgaacctgacggcggccgtgtcctgcgcgcgtcggaaaacggcgtgcacgcgggttatgaagcggcgctcgaggtcctcgccggcagcttgcccgatgcgattttcgcagccagcgacgaactggccttcggctttatgaaggcgctgcttgagcatggggtcggcgttccggatgaaatcgccgtcacaggctttaccgactccccaaccgccggcatcgttacgccggagctgaccaccgttgagcagccgacgcaccgtctgggaatggtggcggcacgtatgctgtttgacatgatcgacggaattccggccgcggacaccacaccgcaggaaatcgttttgctgccaaagctgaaaatccgcgcttcctgcggcaaccggaggcacatcaatacattgtttgagtaaagtgtattctggaaaggagggcacgttgatgacaaaacccatatcctttatggggctggcgcttaaaaaccccctaatcgtcgcagcaggtccatggtccggcggcgctgcagctattcaaaaatgcatcgatgcgggcgcggcggctgtcattacagaaacgatcgttatggaggaaccttggcttttcagtccgcgcatctactatcatgacgacgagctgctcaatctttcgctgtatggcaagcgcacccttgaggagtgggaaggcgaggttgaacgcgtccgcaaagacagctgccatctgatttgcagcattcgtgcctcaagcccgtcggagatcgcctatatcgcccaaaggacagagcgtctcggcgccgacgcgcttcagcttgacctttacgcgcctatggattcaatgatcgaggacatccaccttcagccggaaaagctttatgagtttgtgcacgccgcggccagcgcagtctccattccggtcatgacgcgtctgccgtacaatctggccgccagcgcgccccatctgcacgctgtggagcgtgcgggactgcgcgctatctgtgcgattgaaagcctgcgtgcgctttccggcgtcgatctcgagacgcaaacaacccttatgccgacctacggcggctatacgggccgccacatccggcccatttccctggctgcggccgcgacgcttgcacaactgaccgacctgcccatctgcggtgttggcggcgttgaggattaccgcagcatccttgaatttatcatgctcggcgccgccgccgcgcagctcggttcggctatcatgctgcacggttatgatctgattaccaaaaccgtgcgcgcgctggaggactggatgcaggcacatggatacgacgattacagctctatcactggggccgctttgtcgtcgcttaccccgtttgaaaaggctgtgcaccgccgcgccgtctgccggatgacgcagccttgcagccgtaccggctgcgggctgtgtacgtgcggctgcatgtacggcgcgcttgttatggagcctgacggcgtgcatctgaactcctcgcagtgtaccggctgcgggctgtgtgtccagcggtgcccgcagggactgttccacctggaaacgttctgatatgaaggccgcccggcattccacaaggcaatgccgggcggcctttatttaaaagtttagaaggggcaggggcgcgcgcgacccgtgcgcgggtcgctcaccgccggacgctgcgcttgcccggccggctattcggggctttccggcggctatagccgccgggcgcgaacaagccgcggcagcgcccctcagcgcgcctcatgggacaggggcgggccgcccctgtcccatggtggacccaaccccggggcaggcgcagcctgtacgcacagcgtccgccccgctgttcacggcgcagccggctaaagttttttgccaagcttttttcaaaaaagcgggaaattattcggcctgcttgtcggggaggatcaggttcaggataatgcctgcgatcgcagcgacagcgagtccgccgatgctgatgccgccggggaaattaaacgtcgcgccgccgactgcaagaatcaaaattgcgctggagacaatcaggttcctggctttggagaagtcgacatggttttcaacaactgtacggacgcccacattcgcaaccataccatacagcaggatgcctacgccgccaagtaccggatcgggaatggagcggcagagcgcctcaaatttcgggataaatgcgaacagcgccatccagacagcgccgcagcggacgacaaacggcgaataaatgcgtgtgaccgcaagcacgcccgtattctcgctgtgaatggtgagcgacggaccgcccagacacgcggaaacacaggtggcgcagccgcatgcgaacagagagcgcggcaggcccggatttttagtaaaatccttacctactgtcgtgccgactgcgatgacgtcgccgatatgttcaatacacgggacgattgccgcgggcgcgattgcgatgatggcgcgcacatcaaatttcggcagcgtaaagcttgggacgccaaaccaggcagcctccatgacgccggaaaagtcgacgagtccaaacgggattgagatcaaataaccgccgacaagcgcgagcacgatggtcaggattttagtaagcccttttccaaagatattgacaacgaccgcgatgccaaaggtgagcagcgcgacaggccagtttgccgaagctgaggatacgccgaccgacgccaggctgaggccgagcacaatgataatcggaccggtgatcaccggcgggaataccctgtttatgcgctctgttccgagcagcttgagcagcagggcaaacagaaaataaaaacacatgacgaaaacaaggccgccctgcgcataggggatgcccatatccgtgatgatcatagtcagcggcgcgataaaggcgaatgaaccgcccagaaacgccggaacaatccccttgtcaataaactgataaatcagggttccgacgcccgcgcaaaacaatgtcacagaaacgtttagtccgcagagtatcggcacaatgatgacgccgctcatggccacagtgttttgaagccccaaaaatatcatctgtttttttgtaaaattgacggacagatcgcttggcgatacgaaacgcgcttcctccacgcggctgttttggttatcctgcataatcattccctcctcaaaaatctgacctcagcttgcattgaacgcacagtaaaattccgccgcgcatccaaaacgttccagcgggattttttccaccagctcgcgcagcggcgtgcagccgtcgggcgatgtggggatcatctcgtcccccaccctttcaatgatctgcgccttggttgcaggaaatgtgatcggacgcatggcgatcacaatataatgcgttgccagcaggtatggaatttcacgcatcatactcattctgttcacctccataagtataagcattgtattggcagcgcgtttcgccgcggccgcccaaatcatggcacgacgcgccgcggtgccggaacgaatacaaaaacgtattggtcacgctgctctcatgaagcttgtcaaccaaaccgggatacagatccgccttgacaatataggggacgccggccggcgcctttgtaatgacgttgccgtctggcgcaacaatcatgctcattccaaatgcagagcatgccgcttccacaccaacgcaattgaccgcgacaacatagcactggttgcagtaggcgcccattttgtttgtgatatcccaaccgttttcccagggactcatgtagtgggtcggccgcacgataatatttgcgccgttgtaagcggcctcgcgccaaatctcgggataatcgccgtcggcgcagacgattgtcgcaatcttcgatccctttggaccgggcgtgaccgggcattcccatccggggtagtgccgctccgttggaatccatgggttcattttgacataccgatgaacgacctcgccctgatcgttgatcatgatggcgcagttaccggggctgtcgtgaccatcaagcttgagaatcacgctgaaaatgccccatacgcgcaggcgggcgcacgcatcacgcaggcgggcgacttcaggcgaatcgagtgtcaaaacgacattgagacgcttggtcgggtgcatcccctgtactgcgaattccggggtaacaaacaggtcatagccaggaaacccgcgcgcgcctgtctccatgtactggatgattgtatcgatgttgcggttgacctcctccatgcaatccgcatggataggttcgagttgtgcgcagacgacgctcagtacttctgattcaaccttgcctccgacgccgtggctgcttccaatgatcatgaaaacccctccttttatgaaacaaatatgtaacaggacttaaacatcctgctctcaagacttttttaaaaagatatttttataaaatttacaaaaatatctttacttttataatcaattatgttattctttatgtaacaaaatgtaacacatctgcaaatcaaagtcaagtgcaaatctaaaaaatcatgctgcggcgtacccaaactcataacaaggtattaacaggagggaatgatatgcaactgttgattcaaaacgcaaggctgcgcggccgggacggtacagttgatattcaaattgaaaatggccgtattaagcgcatcgcgccaaaaattgaaggcgtgcagggcgagatcatcgacgcgcgcggaaaattgaccacaccgtctctgatcgacccgcatatccatctcgataaggtcaatgtatttgatgttgtccggccaaacaaaagcggcacgctcaaagaagcgattgaaatcctgtgggaccaaaagcgcatctacaccgtcgacgatattgtagcgcgcggcgaggacgtagttaaaaaggcgattaaaaacggaacgctcgccattcgcacgcacgtcgacgttgatacaatcggcggcctgcgtccgcttgaaggcgttcttgcgctgcgtgaaaaatataagaacgtcgtcgacattcagatcgtggcctttcctcaagagggtatcgtcaaggacccgggctgcgacaagctgatgtgggaggctatgcaggccggggccgacgttgtgggcggtatgcccgccaatgaaaactgccctgccgacagccttgcgcatgtaaagctctgttttgacattgccgaaaagtacaacgctgagattgatatgcatgtcgatgaaacagacgatcctttttaccgcacgcttgagatggtcgcggatgaaacgcttgcgcgcggctggcaaaaccgtgtgacggcaggccatacctgcgcgttggccgcctacgacgatcattatgcatcctatgtgattgacaaggttaaaaaagccggcgttcatatcatcacaaaccccgtcaccaatctgatgctccagggacgcggcgacaagcagccgatccgccgcggcatcacacgcgtcaaggagctgcttgcggccggcgtcaacgtctcctacgggcaggattgtgtcaaagacacattttacccctatggcagcggcgatatgctccaggtcgccaacgtggtggcgcatgctgcacagatgagcctgccggatgaaattgaaaaggtctatgatatgattacatacgacgccaaccgcatcctcaagctcgacggctacggaattgaggagggctgccgcgccaaccttgtgatcgtcaatgccgacgacgcgcgcgacgccatccgtttgaatccggagcgtctctatgttatccgtgacggccgcgtcgttgccaaaacggtggtggacacacagttgttcctctgatttgtcattacttcttctatcccatatcgccgcaggggccggccgctcgatcgagcggccggcccctgcggtctgtacgcgttttatataaaataaaaagcgcgaaaaaaattttagccggttgctccacaaacaatgtgagctgcgtgaaaaagcagcggcaaccccgcaaaaggcagggctgccgctactttttctttattatttttaatcagctctggatattcgccggcggaaatttgctgacaagcgcctgtgcaataccgccgatcaccgggatgttgtacgcttgataaccatacgatttgaccatggcaatgatgctgaataccagaatcgcgatgccgaccacaagagagataacgccaagtacactaaccacgccgacggtcgcgacagccgatcccgcgacaacagccgccccggcgccgactaccgtcaggatagtgatgagcaccgtcactacaaacgagatcaggttcagtacaaacgcctgcattgcatggaatttgacgaggccgctttccttttccaggaatacgatcacaagcggcagaagccatgcgacatatttgacgaccggtatcaatccgccgacaaatgtcacaagataacaaagcaatgccatgatattggcatccagcccgccgaggctggagcgatgcggttgataagtgttcatttctgggatcctcctcaaatgataatttatcctattgcaccacagcaacaaggccgattttggctgtgatgcaacatgcgcagtccgctgctttgcagcggttgccgccgaacggtggctgcaagcagcaaaaccgtttgcctcgcgcatattgtatcatatattgacgaatctgaaaagctgcgtcagtaaaaatctagtaaagtcgagctaaactgttatttttcacaaaatttcatatccttttaatacgacattctgcgataaccatggcaaacatttttccaacatgacgccataccgtgtgtctgttccatagctgaaggtcgttttaatggccaattcaataaagcgcgtcgcgcgctccatggcgatcgggaaactgtcgccgttcatcatcccgccggtcagtacgcttgcaaaaatatcgcctgttccgggataggacgtgggcacataatcgtaaggcacccgccaataggcattgcgcgcgcggtcataacctacgttcacatagcctccctgcatcgtttcaacgcctgtgatcacaacgtattgcgggcttaattccgaaagccgcgcaagcatacttttgagcgtctgccgtgtctgcggctcaaagcggtatggctcgccgagcaaaacggacgcctccgtcggatttggcgtaatcacatcggccgatctgacaagtgcgcgcatacgcgccatcagttccggtgtacaggttcggtatggctttccatgatcgcccataaccggatcgacgacagccagcgcatcgggatacgctgcgataaacgcttcaacgtcgtctgcttgcgcgggacttgacaggaatccggaatacaccgcctcaaagccaagctccaaacgctgataatgctccagacacggccggatataatcggtcagatcgcgatattccacatcgcccagcccgccggtgtgcgttgacagcacagccgtcggtacaggacatacctgagcgcccattgacgaaagcgttggaataacaactgccagagagctgcgcccgaatccggccagcccatggattgccgcgacacgcggcggtcttttctccatccttctctctccttcccgctttttttaaaaaactttgcaaaaaactttccggcttttttgaaaaaaaagcctcggcaaaaaactttagtcggctgcgccgcgaatcgtggatcaggctctgatatttatataggctgcgccgcgaacagcgggccaatagccgcgtttataccggctttccagcctgcttttcgcttcttttaaccaaatccatataatccaaaaagcgccagcgatgcaaacttctgtttatctgtattttttgcaatagagccgcctgaatccgggcatactgttcatcaggggacgccggcgcgtcccgcgcattcccaacgccctgggcatgggcgcgtaaaataaacggaggtggtatcaatgaacaaatcgacgacgaccgcagtcaccggcgtggcaatggccgctttggcaggcaccgcagcttatatgctgagtcatcgcaaggcaacacccggcaaaaagctcaagcagaacactgcgaaagcgatccgtacgcttggcagcgtgctggatagtgtggaaacaatgatgcgctgaaggccgccgcaaaaaaggccgccgcccgcgccgccctcctgatttttagggcggacacgtgggcggcggctttttaagagcctgcttgcccatatgggaaacggatgcacgcaaagcacaactcatccaatctgaattttcccctccggcacaatcagccggcgcttatgcgtggagcgcgccgccagggacaggaaaaaggataccggaccgagacgcccgatatacatggaaaagataagaagcaataagcacaaagcgttcgcctgagcggaaatgcccgcggacaatccgacggtcgcaaaggcggaaacgctttcaagcaaggcgtcaacgcctgccacagcgtgcgtctcacgcatggttgcaacaatcgcgcccgctgtaatcgtaacagccagtacccccagaatcatcacggcgaatgatttatagacggcgctcttttccacccgccggccaaaaatcagagtatcctcgtcgccgcgaatcacactgtaaaccatcataaaaataactgccacagaggtgatcttgatgccgccgcctgttgagccgggagctgcaccaaaaaacatgagaacagacgacagaatttttgtcacaccgttcattccttcaatggaaaatacattgaagccggcggtgcggcagcttacagaatgaaaccatgccgctccgattttttgcatgggcggcatcggcccgagcgttgctggattcgaccattcaaaagcagctgtaaacagagttcctgcaaaaagcagaattgctgtagctgtcagtacaacgcgcgtatgcagcgtaagctgctttgtatggcggtattgcgacaggtcatagacgacgatgaaaccaataccgccgataatgatcagaaaaccgacaaccgcaatgacaactgggttggcggcataaccgcacagcgacagaaaagccgttttacggccaaacaaatcaaagcctgcgttgcagaacgcggacaccgccgtaaacactgcgacaaacatgccctccgctccaaattcgggtatgaacacaaacatcagaataatggcgccagctccttcgacaacggcggacgttctgataacaagacgcagcatacggtatacatcgggttccgaggaggcgaccgattcctgcgccaaatgcatcccgcgcagtccaagcttgcgcccgatcattacattgaaaaattgtgtcagcgtgacaagcccaagcccgccgatctgaatcagcagcaggataatcacctgtccaagcggcgtccaatgctgataggtatcatacacaactaaccccgtcacacatgtagcggaggttgccgtgaacaggcagtccaaaaacggcgtaggctgtcccgcgcggctggacgccggcagcatcagcaagagcgtaccgattaaaatgactgccgcaaagctcagggcaatcacacgcgtaggcgatgaaaacaagcggcttctgtggttttgtctctgttccaagcagtttacagcgcctttctttttaaaaatataaattacctctctgtgcggacggctggactccgtccggacagataacggcgtgcttcattgatcaggtgtttatcatttttaaaagtaaccatcgtatcggcctcgtcaagcaagcaccatttatattcactgatctcctcctcctgccggcgcaccgtatcgtctccgtcaggcgacgcaaggaaatagacaacctgctttttaacatgcggctttggaaaatattccacgctctgccgaaatccctcgcacagcccaacgtcaagccccgtctcctctttgatttcacgcagcgcagtttgcggctcagtctcgcccgtctccacatgtccctttggaaatgaccaatggccgccgtttttatgccggatcagcagcagctccagccggtcctgctttttgcggtaaacaagcgcaccgcaggatttctcgcgtatcacgatcgtttcagtcctttcaagtcaagcgcggacccgcgccccggttttcacatgcgccgcgcgcagcgcgggctgtacagatacttattaatatatcacgtttgcatctgttttaaaagtgaaatcagcaatttaaccgataaaaagcgacccgcactgtataccgaatgcggcgtctcttatattgcgcggttgacaagatgtcccatcttagctataataaaacggtatctttgcgcctgtagctcagcaggatagagcgaccgcctcctaagcggtaggtcggaggttcgaatcccctcaggcgcgccaagtgggaagctacattttggccctggaagcagggctgaaatgtagcttttcttttatctgaactacaggagtaaaacatccatgttatactgctcatgagaaagtgagcggcaaacatggaggttttatcatgtccggaaatgttattgagatcgcgtcagataaaacgctgggacccattttgttgcagcggctccgtgtggcggcttactgtcgagtcagcacaggccatgaggaacaacagaacagcctgaagaaccaaatcgagttttacaccgattatatccgggacaacccctgctggcagtttgtcgcggtctatcttgatactgcgtcggggctgcaggcaaaccaacgccctggttatcagcagttgcttcgtgactgcaaacaaaagaagatcgacctgatcctggtgaagtccctcagccgctttgggtgggatacagtggagaccatcaaacagatacggaggttaaagcgcatgaaaatgggcgtttatattgaaacaggcggcatcaacacgttgaccaccagcgacagcatcatcgaccaactggtcgctttagaccaggcagagagccagtcccgcagcgagaacatcaagtttggtatccggcaccggatgatgagcggaaagacgctgctcaaccacacccgcttccacggctaccccaaggacccggatggggtgctgcggatcgtccccgaggaggccgagatcgtccggctgatcttcgacctctatgtgcagggaaacggtgtgcggaagatcaaaaagcaccaggaatcccacggcattaagacagttaccggcaaggccgagtggagtacatctaccatcgaccggatgctgagcaacgagaagtatgtgggaaaggttctcatgcagaaaacttatacaccggattttctgacgggcaagaaagaaaagaactgcaggcagttggagatgtacctggtggagaatgcccatgagcccatcattgaccgggaaacttttgatcgggtacaagagatgaaagggaaaatcaaacaggggctacaaatgaaacaagggatgtgatattataatgagaataccagaatagatggaaatgtgatggttggactacaagatatattgcgcttacttcttcattattatataattgaagtaaagcgaggtggaaactaatggcatataaaaaatcaaagaatgtcaatttggatgcacttattcagcgtgaagattttgaagcatctgatgagagcatgaatgcagcaagtaagattgcaaccctctctataaatgacttgcgagaaggaagtggactttttttagcctctgttcgcaagccggatttccaaagagaaaccgccgattgggacatagataaagttgctcgctttataaaaagttttgtagatggtgaatttattcctgcagtaattctttggcgaagccaagctggcctgatcttcgtgattgatggatcacaccgcctaagttctctaatagcctgggtaaacgatgattatggcgatggacagttttctttggatgcatttgatggtgccgttccagatgaacaaagggagctggctaaaaaagctcgcgaaaaaataaacacagaagttggtccgtatagcgattattataaagctcttcgagcaaaacaccccgatactgacataattgtaaaggcccgaaatttagcatcgcgtgcgctcccgattcagtggattgagggcgatgttgctactgcggaaaaatcttttttcaatattaaccaacaggccacacctattgatccgactgaattagaactgttgcaaaagaggaaaagtccaaactgtatcgcagcaaggtcgataatgcgtgcgggtaaaggtcataaatattggcataattttgaacaggatgtgcaagacaatattgaaaaattggccgactcaatcaacaaattactattcgaacctgtcgtaaagcgtcccatcaaatctctcgatctgccaatttgtgataaaaacaataatacgctaacactgatatacgactttgtttcttttgctaatgcaggcgataagaacggagataaagacgattttgatgggcagatgaccatccgttgcttaaaaaataccaaaaagttggtgcaactatttagtagcacggctcctggctcctatgggcttcatcctataatatattgctactctaataaaggaaattttcgcccggcctcgttttatggggcaatggaatttgtgaaacttttgaattcagaccagtatttacgtgcaaaatttattgagaatcgaagattgtttgaaaaatttctatttgataatgattctgtcgtgcaacgcataattgatacttaccgaaggggaactcaaagcgcaaaacacatagccgaatactatatctttgttttggaaagattaaatagtggtgatgatgcccagcaaatacagaaagagctattatccactccgaaatataaaaagctaagattggggtttcccgatggcattgatataacagcatcggattttaacacagggaataaaagtgaagtttttattcgtcagtcacttcataaagccacacgttgtgcaatttgcggaggttatctgcacattcattctatttcgattgaccatattcagcgtaaaagagagggtggaacaggtagcgctgacaacggccaattaacacatccatattgcaacactggcattaaaaattaacgaactggaagcagcgaaaagctactcccagcgggagccgcctacggcggcctgtatttccttcactgaaaaaacatcgtttttaaccaccccttccactaagcaatggtctggagccaactcgcgctccaggcttttttatttttaaaaaaaagcgcccgcgccctacgcatagtgggttcggccgattgctgcaaaaacctgccgcacagtgcgtttgcggcttttaacgggcttcaagagcgttttcatccccatatgcgctctcttgcggttcgctttttcccataaaaagggcaccgctttcctctctttatgattgatgccatactgaacggtcttttattattcaatgcggcagccatgcgtcaaagaaagtcttaaaaatccgcacatatttcctccggtccgcctgggtaaccgctcctttctgcctgacggcacaaaaaggagcagccgttttcttgcgtgaaaataactgctcatagttgatgtattatttttggggaggttgggcttatctgcacggcaaactggaaacggttcatctgtacgggctttgcaattttgtttttatatagtattaccgctatggatctgcatcatctcaatgctctcccacgatggattccatcctctttaaatgttttcactctcttttccacttgagcaaaagcgccgagttcatgatgaccaagacagagccggcattatgtaccagcgcaccaaccacaggattcagtgccccgaagatcgccagcacaatggccagaaagttcagtgccattgagaaggtcatattcagcttaatggtggtcatcatccgcttagacaaggcgatcagatggggaagttccttcacctcgtcgtctaccagcgcgatatccgccgcatccacggcgatgtcgctgcccacgccgcccatagcgatgcctacctccgccattttcagagcgggcgcgtcgttgatgccgtcgccgatcatacagaccggctcaccggaccgctggactttgtcgatataatccagcttatcctgcggcagacagttggctcgaacctgccgaatgtcaagttgcgccgcaatagtatttgccgcgttctcatgatcgccagtcagcagaacaggctggacctttagcgcaaagagcttgacgatggtgttttcactttccttccgcaatgtatccgagagcgcgatatatccggcaaactgaccgtccaccgccagataggtgacggtacagccctgctccacataggcgtccgcctccgcaggggacataaaatcgattccccgctcatgaagcagctccgtgttgcctgccaggatcttttttccgtctactgttacaaacacaccacgtccaggaaccatctgaaagccatcggcgggagaaacagccggaccgctcgattttttgtagcagtccacaatggcttttcccaatggatgctctgagagaacttcggcagaagctgccaagcggtataactctctgtcggtatatgagtccgacaggctcttagccgctactaccttgggcgtaccataggtcagggtaccagtcttatcaaacgcgaccagcttcactctggccagccgttccagagcatcgccttcccggacgagaaaaccatgcctggtcgcgttgccgatagccgccatgacagcggtaggcgtcgccagcaccagggcgcagggacagaacacaaccaaaatggtgacagcccggataatctgcccggtgaacagccaggtcagtgccgctgccgaaagggcgataaccacgatccaggtagcccagcggtcagcaatgcccacaattttcgccttgcccgcgtccgccgattgtaccagccggatcatcctctggatggaactgtcctctcctaccttcacagcctttaattcaaaggcgccaaactgattcaccgtgccgctggatacctcgtcgcccacgcccttgtccaccggcagggattcaccggtcatgaccgcctgattgatggaggtctgcccaaaggtaatcactccgtcaaccggaacgctctcgccggggagcacccgaagcagatctcccacccggacctcctgcgctggaataaccgtttccttcccattgtgcagtacccgcgctgtctggggcgtgagatgcaccagcttttcaatccccgccctggcttttgccactgtcagctcctccagcagagcgcctaactgcataataaaggccacctcgcccgcagcaaaggtttcaccgatacagatcgaggcgatcagagccagagaaaccagtacatccgccttaatatcaaaggccgtgaccagtccgatgacagcctccaaaataatagggacgccgcaaagaatgatggcggcccatgcgatatcaaagggaaacggctgcacattcgccagactgcatatgacagcaatgccggagataaccagcagcgttatatcctttttgatgcctcccagctccaacagatgttccagcttctccatgagtgctttcataatgatcctcttttcattaccatatagggtataggtatataatacctataggggtatatgttgtcaagagggtaaaaagaaaaagcagttcatctgaactgctttgtttatagtctgtcatcccatattggaaaaccgctctacggcttttgtaaaactctcgatggttttgtccgcatctccatgttcaagaccatcccggacacagtgcttgatgtggccctccagcactacctttccacagccgtgaagggcggattttgcggcgttgatctgggccagaacatcctcgcaggggacatcctcgtccaccatccggtcaatagcctgaacctgcccaataatttttttcaggcggcggtgcaggttttcggcatccatacattgtctcatataaatcatctccataccgttatgggtatctattttttatatgatgtcacagcggcgacgggcttgcctgccgctttgcggcagcgaaaccggctttgccggtttcgctgcggtgcagcaacatgcgcagtccgccgccttggcagcggttgccgccggatggcggatgcaaacggctttgccgtttgcatccgcgcatgtgacaccatgtccgcgcagcggcatggtaaaattgtccgtcaaaaggtgtgggccgcctaagcggcaaatcgttgggcatcactcagtattatagccgtcccgcggttattattttacagtggaatgcatcggtttcaggccctggatacgatctctatctgtgaaaaagtaatatttctggccttatctatgtggtcatattttttgggttcatacactttttttaccttaaatcttacagtatcccctatccggaaccgctgctgcttctgcccccaatccgccagccaatgggtttcatctggaatcggttgcgcacccaaaagccagggaggcaaaagcccgtcaatacggtaataatgctcgcctcttgcctcgctgaaatacacgtctgtgatatcagccacataaaaattgtccctgcaacagaccggatcccgtttctggggcagactgcctaaggaatagtattgatcctgatccacattaaaccggtcatggtcaaaattttcctgtacatagcgaatgtgaggctcaaagcattgcccgcagaactcgtcgcttaaatagcgccgcagttcctgccgcgtatacatggggagaactttcgaatcataaagataatcaacataaaatgcgtgcgaggcatatatatcgaaaaaaacactgcgcatccgcaggcagtggcctttttgctgttcgtttatcagcgtatggaccttttcatttaacaggcaggccaccgcggcgtcccattcggtcacagggccgtcccggcggtccagcatgacataacagcccatacagcgcatcaaagcgtgagacagggagcgcgggtccggttgaaatttcatccctaaattcatcgccctggcaatcgtctctttttcctcgctgttccattcgtttgtgtcatctgattcgaacggttcatactgtgcatcgttctgatccttcagccggagaaggacctgccgtaaagttttttgaatatcctcggatagttttcggttccaatcaatacccgtgcggtcgtatccgatatatcttatatgcctgtaatcggagggaacgtcgtccggtgaggcagtcaaaatgacgacctcttttttcagcgcatgggcaatgcccaattcatagttgacatttgggtttcttccggtgacatctgccagcacgattgctgcatgataaatggattggttgatgtcatctataatcggccggttattataaatctcatccgctcgcaaggggtccaggcccatcgcctcgatcgccggcgcataaaccctcttgtagagttcatcaaagagatctccaaagggcatgattacaaaacaaagtttattcatctgatcatcccgcttataaaatccttcatttatacagattatagcaaaaaagatcgaaaaagaaaacaccctgttttggggatttataaaacgatccttttcggctgttgcattcggggctgtttgaaaaatcggaaataccgtctttttctacaaacagcggtgaatccagcgttaaaaagcctcggaatccgaaaggattcctgtgttttttgccttgtattctcctgctgtctgcgaaaaatccggcaattcctctattttcaaacaagccctaagctgacaaaaatatccccagcaccatgccagtgtctttccccatttttgcacggcatggccttgtacccgctgccttgatatggtaaaatcataacatggcggcctgtccggcgtaccgccggggcggcgcaaaaagaatgaaaagaaagttggcgaatggttcatggatcagaacgtattggatcagattgttgcaaaaacgcgcgagctgatggatgctccgacttgcagcggcgaaacaaaagaggccgcgcagaaatggctggacgccgttgggacagacgcgcaaaaagcacagactaaagcgtatattgaggagctggaagcggatatcatgccgattgacaacttgatcggctttgcaggctccgaggccggcgcggcctatttcggcgcggaaaaggccgctcaaatcgttgagcatgcagagcagatcaagacggccggcgcgcggtactgcgactgccccgcctgcgcaattgtcgcgcaaatccttgaaaagaaggacgcgctgctggcattataaaattcatctggatgaaacacccgtatttaaaaaaagcgggcgccggcccattctgtggaatgcggccggctttttttcaggcggcggccattgcctccgcctgaaagcagcgcccgagtggggttttgtgtcctgccccgcgtttaaccgattctgtcctcgggcgattgcacgattctttttaatttctatatggggggttctgacatgcagatcacggaggagctgatccacacgcttgcgccgaacgcggccgcgctcggcaacgccaaaaaaatcgcggcgcgcggcgattttatcaatctcggcaaatcggaggacggcacgtatttatgcggcgactgcaagggcagcggaaaaaatccataccatacctcggccgattttatcgatccggcggcgccggtgctccgctgcagctgcccgagccgtcagattccctgcaagcacgcgctcgccctcttgatggaggcgctcggcggccggacgttcgcgccgtgcgatatcccaggggacatcctcgcaaagcgcgggaaacttgagcagcgcaaagcggccaaggccgccggcacggacgccaaagccgcgccgaaaaaaacaaacgcggccgcgctggccaaaaagatgcaaaaacagctcgaagggctcgcgcttgccgaccgttttgtaaacgacgtgataaccggcggcctggcggcgctttcgggcggttccatacagacctaccgctcactggcaaagcagatgggcgactattacctgcccggcccgcaggcgctcatcaacgccatcctgctggagctggaggcgcggcaggacgatcccgcgcgcgaggaggacagccgccgccggatcatcgaaatccttgtccaattgcacgccaccatcaaaaaagcgcgcgcttttttgcagggaaaggtcgaaggcggcgccgtcagcatggaggattccatgctgtacgaccgcatcggctatatctggcagctttcgcagcttgacgagcttggcctttaccgcgacaatgcggtgctggcgcagctctccttcacaattgaatttgatgcggcgcgcgccgaatacatagacacgggctattgggtcgagctttcgaccggcgccgtctataaaaaggaaaatctgcggccgctcaaggcggtcaagcacatcaaacaggacgacactgtgctggaatgcctgcaaatcccgcgcctgtatctttatccgggcgaattaaaccggcgcgtgcgctgggaatcgtttacaccgcggccgcttacgccgtccgactgtgcggccatccgcgcggcggcccggaccgatctggccgccgcggtcaaggaggtcaaaaaccagattaaaaacgcgctgtccgaaaagacggccgtctgtctgatcgcctatgagcagatcggccggacgcagggcgtctgcgcgctgcgcgaccgtaccggcgctacgatcgagctgtgcgggcgcggctctccgtctgccaccgcctgtctggactatttgccggacgccaatctgctggaaaatcaggtgctggccggcaggtttttttacgatgccaaacgcggacgcatcctgcttgagccgctttccatcgtcagcggcgaccggattgtgcggttgagcttttgaggaaggagtgtatatgaaatggctttgcctcttttgaatgaattgcaggagcgcctgcacgcgtgcgccattgccggtctaaacgtcatcggcgaggatttccgcctggcgcgggcgctcgagcatctcgcgcaggcacaggcttcctcgcctgtgctcgcgcgcatctatcaaaccgccgcgccgctggccgatccggcctgcgccgacaaggcgtccgcgctgctcgacgcgatcacccttgtcgacgccgttgtgctgacgcaggccggctgcggcgtgcagggcgagctggaaccgatcgccgccgactgtcccggcgtcgattcaggcgcgcgctacagcgaactgtcggcgctttacaccgccctgacaacgcgcggcagcggccgctatgaaatcctgcgcacggcccttgaggagaaccgtcccgcgctgcgcgactttcgtctgatggatgcactcgccggcgcgctcgccgacagctacaccgatatcgccgacctggccgcgcgggttctttccgacatgccgcaggccgtgcctttgctcaagcgcgggctggacccggcaagcaagaaaaaggacatggtccgccgcatcgacatcattcaggcggcggccggagcgtgtgaaaacacgctttacctgcgtctggccgaggaaggctcgaccgttatccaggaggccgctgtgcgcgcgctgcgccacgacccggccaacatcccgcttctgatcgaatacgctggcaaagccaagagcggcgtccgctccgcggcgcttgaggcgctttcccagatgcgcggcggccaggtcgacgccttctggcttgaccgcctgacagccgccgacgtatcagctgataccctcgaccgggtatatgagacggattcagacctcgtttcggacgcggtcgcagacctgcttgtccggttggccaaaacggcggatgcgccggccgcccaggacgcgccgcccggccctcaggacgacgaggcgtacgtgcacaatctgctgcgcgccatcgtacataagacctcgcccaagctgttcgcggcgctcgaacagctcggcgcgtcgccggccatgcgcggcagcgggcgcatcagcgctgagggcgcgtccaggctggcgcgcgccatgttcggcgggatgcaaatcgcttcccaagccgcctttacgccgctgatgaccgtcaatttccgcctgatacagacgatgctggataatccggcggcggccggcaccgtgcaggcgctttacagccgctgcggcgagccataccggatcgccggctttgcggcggcgcttctgaccgacgccggcgcggcttatgacgccttcgagccgttctttggcgaccccggccagtcggagccgctgctgtgggtgatgcggacgctctattataacagcaaaacgggacgcaccggcatggcggttgaatccatccggcggattttcaccgattcgctcgaaatccgctggctgcgcatgattttaaaatatgaccactggagacagacgctcggccagccgttagccggccgcggacgaatgtctccaagctggttttcccgcattgtcaatccccacgacgccgaaagctgcgcgctgctgaggccctatctgctcggccgggttgggaaaagcggcgtgggctttgaaacgctctatgacctgcgccactgcgggcagcaggatttcagcggcctgattcccaagacgttcaaatccctcggcgacgcggaatctcgccggatcgggcggtatattgccgcatccctgtacgacgaattccccatgccggagcagacaaaacaggccgagctgacgcgccttcaggcggaatggacgcgccggtaaaaaattcccgccgtatgcagacccgaaaaaacagaaaggacgaacccacgcatggccaatacagaattccagcgtctccccgcggaggagctttatcagaccgagcttgacgcgctgatcgccgccgaacgggaccctgttcccgccggctggcgtatgtcgccgcgctcggtgcttacctatatcaccggaggcgccgccaagggcgtgacaatcacgccgaaatatatgggcaaccgccgcctggtggaaatcgcgattgcaacgcttgtcaccgaccgcgccctgctgctgatcggtgaacccggcaccgccaaatcatggctgtcggagcatctgtgcgccgcagtgaacggcgattcgaccaaggtcgtccagggcaccgccggcacaaccgaggagcaaatccgctattcctggaactatgcgatgctgattgcacagggaccctcgcgcgaggcgatgatcaaaagcccgatttaccgcgcgatggagacgggcaccatcgcgcgcatggaggaaatctctcgctgcgcctccgaggtgcaggacgcgctgatctccatcctgtcggaaaagcgcgtctccgtgccggagcttgcgttcgagctgcccgctaaaaagggattttccgtcatcgccacggccaacacgcgcgacaagggcgtcaatgagatgtcagccgcgctcaaacgccgctttaatattgtcgtgcttcccgcgccggccgatatcgaaacggaaatcgaaattgtgcgcacgcgcgtggagcagctttccggttcgcttggcctgcgcgcgcaggcgccgggcgcggagcttgtcgaaaacgtcgtcacaatcttccgcgaactgcgcggcggcgtgacgctcgacaaatcgcaaaagctcaagacgaccagcggcgtgctctccaccgccgaggcgatttcgcttttggcaaacggcatggcgctcgcggccagcttcggcgacggcgtcatccgcgacggcgaccttgccgccgcgcttcagggcgccgtcgtcaaggatgaggaaaaggacgccgtcgcctggaaggaatatcttgaaaacgtcatgaaaaagcgcggcgccaggctgcgcgcgctctatcaggcctgcaaggagctgaacgcataatgcccatcctgttcggcgtgcgccacctgtcgccgggcggcgcgcaccatctgctgcgcctgctcgacgagatccgccccgagctggtgctgattgaagggccgggcgatctttcctcgctgatcccgcagctctgtctcgacggcgtgaagccgcccgtcgccattatggcttacagtgaaacggttcctgtgcgcagtatcctttacccgttcgccgtctattcgccggaatatcaggcgattctgtgggcgcaccgcaatcagaaagcctgccgtttcatcgacctgccgtccgggacgtttttagcgatggctgacgcgcgcgcgaagcgcatggaggaatccggcggcggggatgacggagcggatgaccgtgagcagctcccggacgggcggtcgaccggcgctgtttacggcgcgctcgcgcgcctggccggcgagccggaccaggaggcgtactgggagcggcggtttgagcataacctctcggacggcgcgtatctgctgggcgcggcggcttacggccgccagcttcgggagacggcggcgcacacccgctatgaaacggccgaaaacgacgtgcgcgaggcgtatatgaagcgccgcatcaatgaggcgcttgcagagggctttgaggatgaccggatcgtcgtcgtcaccggcgcataccacgttgccgggcttgaacgctgcgcaccgctctccgacagcgaaacggccgcactgccgtcgctgcctgcgcagagcacattgatgccgtactcctactaccggctgtcgtcgctgtcgggttacggcgcgggcaaccgcgctcccgcctattacgagctgctttgggacgcgatccgccggagcggcgatcccggcgcggccggctacgcctatttgacgcggctggccgcatatatgcgcgcgcacggcgcgatcacctcctccgccgaggtgatcgaggcgatccgcctggccggcgcgctcgccgggatgcgcggcccagcctttcccgtcctgcaggacctgcgcgacgcggccgtcgcctgtatgggacacggccatttttccgaaatcgcacaggcggctgccgacacggagatcggcgcccgtatcggcagcctgcccgacggtgtgagccgcacctcgattcaggccgatttttaccgctgcctgcgggaattgaagctcgaaaaatacaaggcgctggccgcgcagccgctcgaattggatctgcgtgaaaacacgcgcgtcaagtcggaacaatcggcctttctcgatttgaaccggtcgtttttcctgcaccgcctgcgtgtgctcggcgtccggttcggcacggcggccgcctcccggcaggaccgcgccacctgggcggaaaactggacgctgcaatggacgcccgaagccgagatcgagcttgtcgaatcggccctgcgcggtgagacgatcgagctggcggccgccttcgcttttaaggagcggctggaaacggcccagtccatcagcgagaccgcgtctattttggaggacgcgtttttgtgcggtatgccgcggaccatcgcactggctaccggaaccctgcaaggcctggccgtcggcgcggccgctgtgccggagatcgcggccacggccgaaagcctttcggcggccgtccggttcggcagcatccgccggctcgaccccgcgccgctcctgccgattttaagccagctctttctgcgcgcgtgcctcatcctcccggggagctgcgcctgcgacaacagcgcggccggcctgcttgccggtgcgattggtgcgctcaacaccgttgcgcttaaccatgccgactgtgtcgacgaggcgcgctggctctctgtcctgaccgacctgtccgaccgcgacgacctgaacacaaagctttccggctttgcgacggcgatccttctggagcgcggtaaaatcacgaacgatctgctttccgccgaggtgcgccgccgcctttcgccgggcgtccccgcggagctgggcgcgggctggttcgagggcctttccatgaagaaccgctatgccctgatcgcccgcctgagtctttgggagcagcttggcgcatatatcgatacgcttgacgagacggaattcaagcgcgcgctcgtctttctgcggcgcgccttcgccgatttctcccccaaagagaaaaatgatatcgcggaaaacctgggcgaagtgtggggcgtcgatgcgcgcaatgccggcgaagcgctcggcgctgctttgacagaaccggagcaggctgctttggacgcgctggatgaattcgattttgacgatttgtgaggtgcttgccatgaatactgcaatcgatcccgcgcagcgcctcgcgcgctggcggctgattttaggcgcgcaggcgcaggagcgcctggaacacatgggcgcgtgcggactgaccgaggaacagcttttaatggaccaggctctcggcgccatctatggcggcgacgccggagccgacgcgctcggcgggcacggcgcgggcagcggcccgtcaagcccgcgaatctccaagtggctcggcgatgtgcgcgccctgttcgaccgcgaaatcgtcaccataattcagagcgacgccatcgagcggcgcgggctgcggcagcttttatttgaaccggagctgctgcaaaatctggagcctgatatcgggctggcctccacgctgatgacgctgcgcgaccagatcccgaaaaggtcaaaagaaagcgtgcgcgcattcatcaaaaaaatcgtggaagaaatcaaccgcatgctggaaaacgatatccgccgcgctgtaacggcggcgctcaaccggcgcgcgcattcgccgctgccttccgcagccgcgctcgattataagctgacgattgaacgaaacctgaaaaattataatcccgatttaaaaaccattcttccggaacgtttctttttctttgaccgctccaaccgtacaaacaactggacggtcatccttgacatcgatcaaagcggttccatgggcgagtccgtgatcttttcttcgatcatggcgtgtatcctcgccagcatgaacgcgatcaaaacgcgtatcgtggcctttgatacgtccatcaccgatctgactgaaaaaagcgacgacccggtcgatctgctctatggcatccagctcggcggcggcaccgatatcaaccgttcggtcgcctattgccagcaattcatcgaacagccagccaaaacgctttttttcctgatcagcgatctggacgaaggcggcaaccaggccagtctgctgcgccgtctggaggatatgaaagcttccggcgtcacagtaatcagcctgctggccgtgtcggacagcggcagcccgtattacagcgcgcatatggcgcagcgtgtcagcgcgcttggcatcccctgctttgcctgcacgccgcagcttttgccgcagcttttggaggcagcgctcaaggggcatgatctcacagcgtttgagcgtatgaaaaagaaagcataaagctttacgcgcttagtcattttgcaatgcaaaagaaccgtaaaatagccgcgggataatctataaaaccccggcccgccataggcgggccggggtttttataagtaaccggggagcctgttccctcaaaccgtcatgcaccacgcgcttcgataaaaaacacggtgaactgtttttcgttcggcagataataccggccgtccggcagaagcattgcctgcctgcgtgcatgattgagcgcctgcggcgcgctacagccgggcgaataatggcggataaaagccgccgcatcctccagggagtcagccggctgtccaaattcaagcgccgctgtcatgaatcggaacgctaatccgcgctcttttaaaagcgcggcgacctcgttggagcattccttttgatggtgtgaacgtccggacggcgcaatattacttttctgtcctgtattgacaacaacgatcagttgtctgcggcagagcgacagcaggcggtcaagcatcccctcatcggtcaagcggccaaaaaaacaacagacgacagcatcccacaggctgtccggcggcaggtcgggaaaagccgcctgtatgatccgtatgggcggcgcattgtggacagccgcctgcgcgcgcagcgctgccagcgcccgtgcatcgatatcgacggccgtcacctcgcgcacatagggggcaagcgcaagcgacaggcagccgaccccacagccaagatcgcacagcgtatcgtccggcgtcaggcccattgcaatcatctgcgccagccgcgcgtgaaaatcgctgtacgcggcagccgcctgataccagcgcacgccgtcctcatcccaaaaaaacatggttgtgctcctccaatcccccggacggttcgtcctacgcccgagcgccgcagcagcaggccccctttaggcctgcccgccgccaagcggcggcaaaaccggctttgccggttttggctgcggcgcccatgcgcgtccgctgctccgcagaagctgccgtcatctgacagcagcaagcaacgcaattgctctgcgcatatgatatcacacttttcgtttgcccgcaacgaaaaagcaggcgccccggcagccttgtaggaggccgccggggcgcctgcaaaagagagagtgttttggcgtagcagaattaccgcagcgcgagcggcgcgtcggtcacaataaccgggccgccgactgccgtggcaaagtgcagatacccatttgtatcgatgaaatactgcgaattttcgatcagcgtataaacgttggtcgaagcgtcataattgtagaagcgcagggtatttgtgttgagcgtcgacaggtccgccttgacggccacctctaccggcatcccgaacgaaccctggtgtgccaggtcgatgacaacgatgttattctggaaccacttggtgaacagggcctcaaccgacgcgttaccgacggtgataccggtcttgatatcggttgtaagcgtattcagtgccggattcagatacatgcgtccgataatctggccgctgcgcacagtgtcgaagcagaggatcgacttgacagtcacaccgctgcccgaagcagcctgcacagccgcgtcattggcggttttcagcagatcgggcgagatggacgggacgttggaatagaccgtgtaggccgtgccggacgtgccgccctggcctttgacggacgtcactacgccgccgacattcttcttaaccttactcgtcagatcggccgccttgatgacattgccgccgcctttgaccggggtcgtggccgcgccgcccttgttattcaggcgcgaaccgccgccactgctgccgccaccgccggaggagccgccgccaggattaacaaccgggggctgcggatcggggtcgggatcaggatcggggtcgggggttggacccgggtcctcgccgccctcaataccggcgtcgacattgtagttgctgaatcgcagatacgcgatttcggaatggtcaatcacagtgccgtccgcccatttctccgcgccatccatagtcgtgtaccagtagagcggttcatgtatcacaactgttccatcagacaggacgccgttgtgcatctgcggaatttcccgatcaatctgatccgcaaagctcttgaacgtatcgcccttttttcctgtgacataatcgaacctggtcgacagattttcggcggctacacgttcaaaggagacgttagcgcgatcgcccatgatatagatgtatgcatcggtatcgatgcgcgtgctgccctcatttttagttgtatagaccgtcccgttatatgtgaccttgagctgaacggaataggtttcctctgttccgggcagtgcaaccttgttgacaagcttcccgtccctgatttcgaacttagcgttatcaagataggtgctgtccgggtcgagttcaaacgtggccggcgtcaactggcgatcctcaccggtcgtttcgttccaataccagaactctaactcggagctgatctcgccgggcgcgtactcgccggtcttaaccggatagtccgatggagaagccgctacataatattcttccgtatactgattgtagctcgtatcctccttgaaggtcgctgtaaacgtgagttcgtctcccggattcggataataattatcaccgatatgatcactcagatcgaatgtttcgttgatcgcctgcccatcgctgcctgttccggtcattgtgaccgtatcaatcgtatagccgtcagcggcgatgtaatcaatcatcaaatacgcaacgcccgtatagccgcccctgacgcgcaacgtcgtcggatcggtatacggcaggatggttgtttcacccacaggcaggatcttcgtgggaccctccataccggtgtcgcccacggttgtgatgtcaagcacgccgtttttcgaggtgttgaccgtgactctgacatccttgtcggacgcagccgcttcgtcggcgttgaagaacgcgaattcgctgaagctgtcaacggtgaactgcatcttgccgtccacgatcttgaccgtgagcgcctcggtaccgtctttggcaaagtgcagggccatgatcgttttggaagcgtccagccccttcggcaccggcagggtgacggtcacattgccgccggtcacatcaaggctgatgtcgtaaatgacaaccggcgattccggcgcgatttcgacattcggaaacttttcgatttcctccctgacgctcgtctccgtgttggtaagtccctgatcggtgatggtcagggtcgcgccctcgggagcgccctcgatggagacatcctccttgttcatgccggccgggactttgatttcattccacttggcatacagggttgtgtcctcattgaaggccgctgtgtccaagtcgacggcattactgcttgtcccagggttctgctccctgtaccagccgccgaacgtgtaaccgccgcgcgccagctcgtcctctgtaaacgggcacgtgaccttaccgccggcctctgtctcggctttctctgccgccggcgcgccatcatagttcaaatcgaacgtaatggtaactgcgcccgagtccacaggtccggaatccgtgcccgaatcgacagcagccgcgcgcgcaacatccgcagcgaccgctgtcagcgccaggctgaacaccatgaccaccgcgagcaccagggatagtgctcttttcattggtacctctcctttctgattttcccgcttttgcggtcgataaaatttttatcccatctgcgtgtgtcgcataaaatgagatattaatcacataatatcacattaaaatatacaattcaagcgtttcatcacattaaatggaataatcatttaattttatcgactataatcactttaaattataattatgagaggttcttttgtgtgggaaactgaattttcggataggctttgtaagctgcgcacgcaaaaaaaggtatccgcgcgcgacatgagcctttccctaggccaaagtcccggctatatcaaccgtattgaaaaccgaaaggccctgccgtccatgtccagtttttttgctatttgtgaatttctgggcgttacacccgccgaattttttaacgacacgctcgatgcgccagtcctcttgcgcgaggccatcgccgaactgcggcggctgcccggcgacgagcttgcccatgttacagctctgctgcgtgatcttaaccggaaccggcagtcctgataacccgcattcacagccggcggcgccggaaaacaacaggggcgtttcccgctcaaagcgggaaacgcccctgctgttttctattctttacaatttgtcggtcttcagcgcgcgggacgcattgaggatcgctatgaacgaaacacccacatccgcgaacacggcctcccacatgtttgccataccggccgcgccaagcagcagtacaagcgctttgacgccaagcgcgaacacgatattctgatgcacaatgcgcagcgtttttttcgcaatgctcatggctacggcaatttttgaaggcttgtcgtccatcaacacaatatcagccgcctcaattgccgcatcagacccaagcgcgcccattgcaatgccgatatcagcccgtgaaagtaccggcgcatcgttgatgccatcgcccacaaacgccagctttccacgcggcgatttttccttcaaaagcgcctcgacacggtccaccttatcgcccggcaaaagctgtgcatgcacctcgtcgataccaagctctttggcaacgctttcgccgacagccttcgcgtcgccggtgagcatcactgtcttgcgcacaccgcgccgtttcagctctgcaatcgcttctgccgcatccggtttcagttcgtccgaaatcacaatgtggccgacatattccccatcgagcgacacatgcacggtcgtaccgatacggtggcacggatgccacggcacgccgacctcctccatcagtttgtcattgcctgcgcagacggtatgtccgtcaattacggcgcgcacgccgcggccggacagctcctcaacatcggacacccgcgccgattcaagctccttgccatacgcctcgcgcagagagcgcgaaatcggatggtcggaatagctctccgccagcgcggcaagctccagcagacgcgcttcacttaccctgtcgggatgaaccgccgttacattgaaaacgccctttgtcagcgtaccggtcttatcgaacacaacgatttccgcatcggccagcacctcaaggtagttgcttcccttgacaagcacgccgcgttttgacgcgccgccgatcccgccgaaaaagctgagcggcaccgagatcacaagcgcgcacgggcacgagatgaccaggaaaatcagcgcgcggtgaatccattcgttccacgcataaccaagcgccaacggcggcacgacggccagcagcgcagccgcgatcacgacggccggggtgtaataacgcgcaaaccgtgtaataaagttttcggcgcgggcttttttgctgctcgaattttcgacaagatccaggatttttgcgacggttgattcgccaaagatctttgttacccgcacacgcagcaggccgcttttattgatgcatccgctgatgacgtcgtcgccgggctgcacgtcgcgcgggagagattctcccgtcagcgccgccgtatcgacagcggacgcgccctcgagcaccacgccgtcaagggggattttttcacccgccttcacgacgatcacatcgccgacagccacactgtcgggatcaacgcgatggagcttgccgtcgcgttcgatattggcatagtccggccggatatccatcagcgacgcaatcgactgacgcgagcgcccgacggcatagctctggaaccactcgcccacctgatagaacagcataacggcgacgccttctggatattcgccggtcgcaaatgcaccgaccgttgcaagcgccatcaaaaagttttcatcgaatacctgtccgcgtgtgatatttcggacggcgcgccaaagcacatcccagccgacaactgcatatggaacgataaacgccgcaagccgaagcgcgcctttttgcggcagcagcagcgcgagcgcaaacagtacggcgccggctcctatccgcacaagcatttttttctgttttttgctcatggcttagaatccccttccgaatccccgaatctctagagcttgtttgaaaataaagaaattaccggatcggctgtccactgttggcggcgcagcctgtttttcgcagcgcctaccccactgttcgcggcgcagcctgtttttacacagcgcccgccccgctgttcgcggcgcagccgactaaagttttttgccgagctttttttcaaaaaagcgggggcgcagccgactaaagttttttgccgaagccttttttcaaaaaggctggagaatggtgcagtcaggttcgatctttcggcaggtcttgacgacctgcttcatgatatcctcaaagcgcgcgtcgtccgcgtcaacggtcatcttctgcgtcatgaagctgacggacgcgtcattgacgccatcgatccgcttgatcgcctcctccattttggcagcgcagttggcacaatcgagatcagccagtttaaattgctttttcatgttccagactccctttaccgttttatattgaaaaatttattccgcaacgtgctccatcccctggccgagaatcgtgcgcacatgcccgtcggccagcgaataaaatacggttttgccctcgcggcggtacttgacaagcttgctttgcttgagtgcacgcagctggtgtgaaatcgccgactgcgtcatattaaggagctgcgcaatgtcgcagacgcacatctcggactcaaacagaacgtacaaaattttaatacgcgtgctgtcgccaaagattttaaacagttcggccagatcatagaggatctcatcgtccggcatctcactgttaactttgttcacaatttcttcatgcgcgtggataaattcacagcgttcaatttcagcatccatgcaaacaccctttcatatgaaccattgttcatatattattatatacaaccgcttttaaatgtcaagcctttttcgttattttttaaaaaagcagcgcgcccgctatgacagcgggcgcaaaaaatccccggcggacgcttatggttcgctggggatcggtgatttgtctgaaaaacagggaacaacgtccgctctgaccgcggcattcaaacaagccgcagtcaaaattcaaacttttctgtttttcccttgttgttgcgcttttcacgctcggctgcgatgcgtgtcaggctatcgatatcggtgcgttcacggtcggcctcctcgtcgatatagtggctgaccatgcgggagagtcccacatcctcctcgatttcacggatctgcgttgtgaactcatagtcgcccggcacaagctccagcccgcgccgtgccgcggccatcgcctcctcgcgctgcttgcagtgatagctgatgcgtgaaagctggagccatccccacggatactccggatcgctccgcgtaccctggcgcgcatattgaagcgcctgctcataccggccgagatatgtcagcgccacagaatagcgatagcaccacacgccgctatttgcgccctgcttttccacattgcgcaggatttgttcggcgcgccggtacccttcgtatgtgtcaagattgatgtagacatatgcgatccagagcactgcttcaaggtcgttttcaagcgcacgctgtgtataccgccgctcacgcacgcctgcgtagaggtattccacaatctgatacagatagcattcctcgtcgagcttttcgatatgcgcgcgcatttcctccgtcaggattgccatgacaagcgcctcctttcactttcagggcgtttatgcttacagcccatcatctgacggctcatcggattcatagtcatcgccgtccgggttccattcctcatcgatttcaaacgcaccatcgtcattgcggaaatatgcggttccatacggcgcattcagatatggaaggatgtccggatcataattacagatggtattgagggtaaaaatgcccgacttttcgggatcatccatgtattcgtcatcctcatctccagcggtaaaacgccagccgctgtccgggacatcgctgtttggctcctcgcggtacataaaaccgaccggactgccgtccactgtgatccggtcagtcgcaatacagccgtccggaccatcccaatttgtgagcagctccttcatctcatcggcgctcttggcccattttttgcggctcatgaaagcgcagcagtcggggcgcgtcacatccatcaccggggaatatgcttcgccaaaccgttcgatgagcagatcagcgccattggccaccttaaactccatctcattttcataaaccggcaccatctgataaaaacagatccggctgccgtcgtccatctcgcaggcgacctccccgccgtcggcgtccggtccaggcgtggcgagcagaatcccgctgaagggcgtcccttcggcaaacggcccgccgttgggcacggtatgcccccagccgagccaggagttttcattgccgggcaagcgcgccatcaccttgagccagcgcatgggccagtaccatttttcatccttctcctgcaccttccagtccggcggcaggcaaatcaccatctccgcgcgatccagccgttcgcggcgcagctcgtccgggacgttcatccggtgcgcgcccatgcccattgtgacgagcgtgtaataattgcgcttctcatccggcgcgatgatcgcaatatcgacatgaatatccggcgagatcagctcgtggaacacgctttcataacggccgaaacggcgggcaataaacgattcaagccggtcaagctcctcacggctgtacagctcgggcgcgaaacgcacggcttcacggcggcccggcgcggagtcgtcagcctggctgttctccttgagatatttcgtctggcggccgcggctcttattctgccgatcggacaagcgcatcgcacggcgcagcatatcggcgcagtcctcatcacccggatgcagcgccagcgcctgacgaaaacaccgtgcggcgtcgcgggcgcggtcgagataataataggaatatcccatccggtaatgccacaggtaatcgttctttccttcctcctgaatagaaagaagttgcacagccgccttctgataccggcccagattgttatatgcgcgcgcgagctgtgagaccgcctcataatcgcgctctttttcatctatcgccaaaacggcatcgacaattttttgatattcatcggcctcatgccagaggtcaaactgctttttcatctcctgatccataaatccggtcccctcgctttggtttgccgccctgcggcgtctgcaaaccgctcctctttgatatataaagatacatccttcattataatcgattcccaggacaaagttcttccctaacaatgaattttttatgaataaactttaacgattacatgacctttacgcggtcctcacagcgctgtcctgccctcccggaaaaatcctccgctgccggtcatgcgctggcagcacagcgcatggaatcaaaagggaagggccgaaagccctcccccttttttcggtgcgctgcgcgaaacccgtatgcgcccacggggcatccaccagcaaaatgaagcggccatcctgtccgcaagcgtcaaaggcatccccaaatgccgcgcgcgtattcggcgacggtgcggtcgctcgagaacggcccggcgtgcgccacgttaagcaggcattttttcgcaaatgcggcgcggtccgcgtaatcgcgattggcgcgcaggcgcgtatcgcagtacggtataaagtcgtgcagcagaaaataacagtcgggcgcgtgccagcttgcgccgtcaagcagggcactgtaaagctcgcggaacatgccggtacggccgtcatcgagcgtaccgtcgatcagcgtgtcgacggcacgccggatgcgcatgtccgattcatacagggcgcgcgggttatagcgcccgtccagagcggcgatctccccgaccgtcgcgccaaagatatagttgttttccactccggcgcgctcaacaatttcgatattcgctccgtcaagcgtaccgagcgtcaccgcgccgttgagcataaatttcatattgcccgtgccgctggcctcggtgccggcggtcgaaatctgttcggaaatatcggcggcagggatcagtttctcggcgtatgagacattgtaattctggacaaacaggaccttcatacattcacgcatggcaggatcgctgtttaccagccgcgcgacctcattgataaacttgataatcgctttggcgcggtaatagcctggggccgccttcgcgccgaacagaaagaccgtcggcgtaaagtcccggatgcggccgtcctgaatcccaaaataaaagtccaggatggaaaacgcattgagaagctggcgcttatattcgtgcaggcgcttaatctgcacgtcaaacataaaatcgggacgcaacctgacgccctcgcgcgcctcgataaacgcacagagctgctccttcttctgacgcttgacgcgcaaaaaagcgtcgagcgcagtgggatcgccggcatacggcgcgagcttttcgagcgcgtccagatcggttatccagccgctaccgatacgctctgtaatcagcgacgacagctccggattgcaaagcgccagccaacggcgcggtgtgatgccgttcgtcttattattgaagcggtcgggataaagcgcgaaccattccggcagcgccgtgtttttaagaatctccgtgtgtattttcgctacgccgttgaccgaatgcgaggcaaaaatcgccatgtgcgccatgtggatcatctcgccgtcgatgatgcggtaccggccgcgtcccgcgccggtgatgccgcgcgccttgagcgcgcggccaagcgcgtcgtcaagcatgacgatatacggatacacctgcgggatgacggagcagaacaggccgacatcccatttttcaagcgcctcggccataatggtgtggtttgtgtaggcgaacgtgcgctgcacaaccgcgaacgactcgtcaaacgaaagcagataatcgctcatcaggatgcgcagcagctccggaatcgatacgacgggatgcgtatcgttgagctggatggcatattcatcggcaaaatgtgaaaaatcatcgccatggcgcgccgtataatcgcgcagcaggctttgcagcgacgcgcttgaaaagaaatattgctgcttgaggcgcaagcgcttgcccgccggcgtgtcgtcgttcggatagagcaccgcggagatggcctcggcttcgtcgcgcaggcgtacagcctcgctgtacttctgttcattaaagagcgcgaaatcaaatccctcgccgtcgggcgcctccgactgccacaggcgcagggtgttgaccatgccgccgccataaccgatcgccggcatatcgtaggggacggcgcgcaccgtttgaccggaaaaggtcacgaggacactctcatcatcgcgccgcacgctccacggatcgccgaagcgcagccaattgtcgggcgtctccatttgaaagccgttttcaaagtgctgccggaacagtccgtagcggtaacggataccgtagccgtcgagcgggacgcccgtagaggcggccgaatcgagaaagcacgcggccagccggccaagcccgccgttgccgagcgcgtcgtcctcgatctgttcaaaaacagcggggtcaacgccgtgctccagcaaatagcggctgcattcatcgagcaggccgaggttaaataaatttgcatgcacaagccgcccgacaagaaattccgcggaaaaataacaggcgcgctttttgcccggttcctgtttccactgcggccgcagccgctgcatcgcggcccgcgaaacggcgctgtagagcgcctccggcgaagcggagcgcgcgtccgcgcccgtttcaaggcgcaggatttcgtcgatctgttcagtgaaggggttcatttcgttcctcccgctgcggccgcagcgcgcgcccgcaaagattcattcacaacgccgttccaacaggaaaagcgcattggtcggcgagaaaatttttgtctttcaaaaaggaaaagcgcaaacgttcccgcaggttttcagcttttccggcgcagtccaaacgaaaaacttccaatcgggacgcgcgccttccccggttgtaagaagccgtaccaattgagggaagtacatggaccagcataaaaaatttttcggctggcaaggaaggaaaatacaggaatcctggcggatttcaagcttttctgacgcagttcagacgggaaattttccaccgaggcgtgcgcgcctcccattgatacagcttctaagggttttaaacgcgcggcggcacaacaggacggccgcggcccgcacgccaggcggacgcagccgcccggccggggcgcgcgcgcgaaggcgcaggcgcgtccggccggccagccgttcccggcagacggccgtaaatctttgtcaggcggcggatggcggcgcgcagtcccgcgccgggttcgcccgcgcgcatgcgccacatccagttgccgccgagcgtcgacggcgtgttgatgcgtccctgcgcgcccaggcgcagccagtcggccatagggatgatcgccgtatcgcagacgctggaaagcgccgcgcgcaccattgccagcgtaaaatcagcgtcctcgccgacgcccagatattcgcgcgcaaaggccacgtcgtccggcggcgcgctgtcaatccagtcgcgcgtggtggtattgtcgtgcgtcccggtatagacaacgctgttgcgcgtgtaattatgcggcagataatcgctttcctcacggctgtcaaaagcaaactgaagcaccttcatacccgggaaaccgctgtcagccaacagccggcgcacctcgggcgtcaaatagccgaggtcctccgcgatgatggaaagctccggcacctcgcgccggatcgtttcgatgaaagcaagtccgggtccgggtttccaatcgccgacagccgccgtttcagatcccgccggaatggcgtaatagccggcgaagccgcggaaatgatcgatgcgcaccgcgtcataaacgcctgcggccgcgcgcaggcggcgaatccaccaggcatagccgtcggcggcgtggcgtttccagtcgtaaagcggattgccccagagctgcccatcggccgaaaaggcgtcgggcgggacgccggccacggccgtcggcattccttcgctgtccgtttgaaaaagctcgccgtgcgcccacaggtcggaggagtcgggcgacacatagatcggcaggtcgccgacgatcaggacgccgtgcgcgtttgcatacgtcttgaggcgctcccactggctgaaaaagagatactgcacagccttccaaaaacgcacgtcgtccgagaggcgcgcgcgcgccgcagccagcgcgtccggctcgcggcggcgcagcgcctccggccacgcataccaggcgttcatgccgcagtcagccttgattgccatatacagtgcgtattcgtcaagccacgcgtcctgcgcgcggcagaaggccgcaaactccggtgcatcgccaagacggcgcgccgcgcgccgcaggacgtcgaaacgatttttatacagctttccataatctacggcgtccgggttgtccccaaagtcggcggcggcctcatcgcgcgtcaaaagctcctgctcaattagcagatcaaggtcgatcagatacggattgcctgcgaaggcagaaaatgattgataggggctgtctccatagccggtcggaccgatgggaaggatctgccagtatgtctggccgcactcgcagaggaaatcgacaaaatcaaacgcggcctgcccgacagtcccaatcccgtatggcgacggcaggctgaaaacaggcatcaggataccgcttgcacgtatcaaacagaactcccctttccggccattttttcaaaaaagcctcttaccttttttgaaaaaaaggtaagccaaaatactttattcggctgtgcccccgcttttttgaaaaaaagctcggcaaaaaactttagccggctgcgcccccgcttttttgaaaaaaagctcggcaaaaaactttagtcggctgcgccgcaaacagtggggttgggcgccgcgcttatacaggctgtgccgcatacagcttctttctccgtccggcggctgtgactgcgttccttttgcagttaaagttcgctgatatggcagacgatctcgctatccgaaacatcgagcacaccataagtccggccgccgccgcgcggttgccccagacttccgggattcatcaggtaaaccccattttcatatttgacatgcggaatatgcgtatgcccataaaggatcacatttgccccaacttcctgtccggcagtcaagagcgcatccaacccgtattttacacagtatatatgaccatgcgtataaaaaatacgcgccttcatgcagccataaaatcccacggacgcctcgccgcttgcataatcgcaatttcccggcgtctgtaaccatttcacatttggatatatttttttcacagcggccagctcctgcgcgccgtcgcccagatggataaacaaatcggcagtttttttatgcatcaacaccaaacgctcaagcgatttataatcgcggtgcgtatcagaaaccacaatgattcgtgtcatcaaaaaatggacctcccgccgcccatataaaaatcgggcgccgtcagaatccgggaggcattcccggcgtgtatctgcaccggccaaccgccgtgcgcagtcacacaatttcgaatatctgctattaatataacatagaatggaacgaaagaaaacaggcggtgactttgattgaacaacaattttaatctttccccggaacagaccgacgcgcttttatccatggccagcaaaaagatggggattgatccggcggatctgcgcaggcagatgcaaagcggagatatgagcggcgtgctcagcgggcttgcgcccgagcagcgcgaccgtatccaaagcttgatgcagaatccggcggcgattcaacagctcgtacagaatccaaaggtccaacagcttctgcgcggcctgatgggcaaatgaaaccgaccattttttgatgattttccgtagccttttgccatccggccataccgggcgcacagggaatcgaacaacacggataaggagatgcagacggtggatgatctgaattcgacacttagcgccattctgggcgacccggccaagatggaacaactgcgccaagtcgcgcagtcgcttggcatcggaccgggcacaggcgcgcctggcgcaggcgcgtcggatgcgggcgccgcaaacgccgcgcccgccggcgggcaatccaatggacagggcggcggtatcgatccaaacgccatcgcctcgatcctgcaaaactttcaaaatgccggaaacggcggcgctggcggcgcggcgtccggcacaggcgccacgccggatcttggcgcgatctcaaagcttacagggattttaaattcctttaaccaaagcgataagaatgtcgaattgctgcgcgcgctcaaaccgcatttttcaccggcgcgcgccagtaaaattgacgacgccgtgcggatcatgcagttgattcacgcatggccgagcgtccgtgacagcgggctgctcggcagtctcggcaatcttttctcaggggggaatcgatcgaaatgatgcgatggaacagtacaaagacgtataccgaggaggatatgatccgcatgcagcaagaggcggtcaaccgtgtgcatgaatttcagacgcgcgcgcgggaagcggccgcctattacgatgtgcccgtatccgacattcgcgacctgcccgccccggtggaatcagccgccatctctgcggacaacacgcccatcgaggcgcaatccgaaattgtatcgaaccaatcccccccacatgcgggcgatccgctgcatggactgctggatgggctgaatctcgacagtgaaaccctgctgatcatcggcctgctgtttttgctttataacgagcacgccgataatgtccttttgctcgcgcttgcctacctgcttttataaatcctcatcgccggccggcccccgttgtttgagcgccgctttgtaaagcgcgcccttcgggtggccggtctgttttgcaatatcgcgcgcggcctgtgacagcggcgcgccctgctgcgcgcgctcaagaagcatgccaaccgcctcgtcaaaaccggccgcctcatcgcgcgccggccgcgcgccctccacaatcagtacaaattcgccgcgcggcggattttcctcataatattgtacagcctgtgcaagcgtcgtcctgtgcacctgctcatgcagctttgtcagttcgcgcgccagcgtgacgcgccggtcgccgaaggcggacagcatatcgcgcagcgttgcgcacagcttatggggcgcttcataaaaaatcatcgttgcagtctgcgtgcgcgcctgctccagatgttccatgcggcttgaacgcttgacgctcaaaaagccttcgaatgaaaaccgcgccgtggaaagtcctgaaaccgccaaagcggcgaccgccgcgctcggccccgggacaaccaccgtttcaacgccgttttcagcgcacagccggacaagatcctcgcctggatcggatatacacggcatacccgcatccgtcacgattgcgcagtcctcgccgtccaaaatccgcgtcaggatcatctgcccgcgctcgcgcagattgtgctcgtaatagctgaccatcggctttttgatctcgaagcggttaagcagcctgagcgtcacccgcgtatcctccgccgcgataaaatcgacggcgcgcagcgtatccgccgcgcgcggcgacagatcgcccaaattgccgatcggtgtgccgaccacatataatttccccgccatatccgtcctccagcttcctcaattaagcgtcattttccgtatttttacttcatcagacgcgtttgttccaaaatcaactccatgaaaatatccgcgtgcggattgtcgtgatacggcgctgtctcataaaaaccgacgcttttatacagcgcgatggcggcggtatcctgcgccctcgtatcgagcgccgcccgtctgtagcctgactgcgccgcaaaggacagcgcgcggccaagcaaacgccgcccatatccccggccgcgctggccgccgtcaacaaacagcgttttaatctcacacaagtcctttcccacacgccgcacgcctaccgtccccaggacatgcccctgcatgtcccgcagacaccagaatccctggccaggcccgccataggatacgccgatccgcgtcagcggagcatgtcttccccgaggctcaaagctgcggcccgtttttggaatgcatgattgcaaaaatgcaaatacggcctcctgcatatccggcttaaacattacaatctccacgcaatcccctcctggaagtaaaaggccggaagcccggcgcctgcaaaatccacgccagccgcatggcgcctgtcatgacttttgccagtgcaagccccgcctatgggcgggtgtcttgcggcctgcgggccgctcacggggccggccgggcaagcccagcctgtataaacgcagcgccaaacccgctgttcgcggcgcagtctgtttaaatcccgaaacctgtcctactgttcgcggcgcagccgattaaagtttttcgccgaggccttttttcaaaaaggccggaaagttttttgccgaggcttttttcaaaaaagcgtgaaagcgcgtcaaaaaagcttgggaggttcgatggtcatggaagggcgtccgccgcggcgggcttccagtaaaaaaagccagggcgcatgggcggcgctgtgctgaaccatacgcaggcgttttggctccaggccgtgcgcgcgcattgcgcagaccgcatccgccaaacgttcgggacgctggcagatgcacagcctgccgccgaaccgcagcaaacggctggcagcggcgcagacatcctccagcgtgcagtcgatctcatggcgcgcggtccgcgcgcccggcgcttcgcttaaaaggccgcggcccgcagctttatacggcgggttgcaggtcacaatgccgaacgctccggccggcaatacatcctgcaaggcgcgcagatcggcatgaaccggaataaaacggcccgctggcaggccgccatgcgcaaccgaccgctccatcagccggacggcgtcggcctgaagctccactgcatatgcgcgggcgggcgccgtctgcccgccgcagaaccaccgcgccgcaaccgtcccgcatccgctgcccagatcgcacgcccattctcctgtgcgcggcgcggcaaattctgaaagcagcagcgcgtctgttccaaccttgtgcgtgcctgaaacatacagccggatcgtcccaaacagttcaaatgtgtccacacagcccctccccctgaaaaagaaaagcctccgctttaacagcgaaggctggtttcttatgtacgccggtcccttattcgggcttgatcgcctcgctcgggcagtcagccgcacaggccccgcactcgatgcaagcagacggatcgatctcgtacttgccgtcgccctcagaaatcgcgccgacagggcaggtatctttgcaagcaccacaagagacgcacgcatcaccgataacatatgccatggggaacacctccaaaaaaaaatacttttttccgaacgcgcgctgcgcgtataacaccactgcacacaacttgcgatgttacaagcctattttaccacagtcccgagaaaatgcaagtgaaaatacaagtaaagttttctggcaaatcaaaaaaatgcggcccgcgtttttattcctctgtctgatcctttgcctgcgcgcgctcatgacattcacgggtcatgcgcacttcatctttatggtaaaatttggcagcggcctgatccttctccggcgcaaccttgagcataccggtcaaaagattcacctcaatcacagtgccgcggccttccttcgtgcgcacgactgagccgacgcgcggcgttgtgcgcagcaagtcctcataggcggcctgttcatattttaaacagcacatcaagcgcccgcaggtgccggaaatttttgtgggattgagcgacaaaccctgttccttggccattttaatcgatacgggctgaaattcaccgagaaaggtcgaacagcaaaacggccggccgcagatgccgatgccgccgagcattttcgcctcgtcgcgcacgccgatctgccttaattcgatacgcgtacggaacacggacgccaagtccttgacaagctcgcgaaaatcgacgcgtccatccgctgtaaaataaaacagaattttgttgttgtcaaatgtgaattccacatcgaccagcttcatattgagcttatgccgcgcgatcttttcttcacataccttgaaagcatgcttttccttcgccgcattgtcgctgacgcgcttcatatcctccggcgtggcgattcgcatcaccttcttgagcggcttgaccacctctttgtccccaatggtacggttgcccattgcgacctcgccgcattccacgccgcgcgccgtctcaacaatgacatgcccgcctttttcaatcatcaggccgcccggatcaaagtaatagaccttgcccacgcttttaaacctgacgcctataatttcagccattctattcctccagtttcaaagcctacccgcgcgggcgctcaaacggccggacgccggttcagccaagcgtcgatttgatctgttcaaccatacacgcgcacagcaaaggcacgcctgtattgcgctcggcacgaatccgcgcagtctgcacgatctgcgcggcagcgaccgcctgacccggtgaaacacggttggaaaagcgcgcgtccgtctcgcggccaagcgccacctgggcaaatccttcacgcagcagcgccagcgtttggccaagcgcagcgcggtccttatcatatgccgccagaatacgcagcgccgtataacggtcgccaaacacaagcgcctcccgcagcaggcgcgcgtcagccgcagccttcgaaggctttgccgtttttaaaagcgcgcgcgcctgtccgatattcccggcggctccagccgcggccgcgcgccgctgctcctctggcgcgtcaggctcaagcgaggcgagcgcctcggcgcattcgtcgggcgaaggcgtttcaagctcaaccgaaacaacgcgcgacaaaatggtcgggagcatctgcgcccggttttcacacagcagaataaagtaaacgccggcaggcggctcctcgataatctttaacagcgcattctgcgccggcgcgttcatcgtatgcgcctgatcgacgatgtaaaccttacacgcgccctcattcggcgcaatatatgcatcctgacggatatcgcgcgcaagctcgacaggaaattcctttttcccctccggcacggtataaaagcgcacatccggatgtacgcccttttcaacctttatacagccggaacaaacgccgcacggccgcggcgcgccggtacacagccgttcctgcgcgatcagggcggcggccgtttttttgccgcagccggccggtccttcaagcagcagcgcatgtggaaaccggccgcccgccgccagcccggacaacacggcgccggcccggcggttataaagcagcttttgcatcagagcttttcaaaccgttcaatattggttacaaagattgtcgccccgccgacctgcacctccactgggaacgaggtgtacatgcccacgccgtacgaggccgaggacggcaccatctgcgtgcgcttttttgagtgcatcccaatgatgcggatcacatcgtcgacacggtcgtcgtcggtgccgatcaaaaatgtcgtattgcccgccatcaaaaagccgccggttgtcgccagctttgtgaccgagtatttattttttgtcagctccttggatacacgcgaactatcgtcgtttgaaacaatcgcaaaaatcagcttcatacagtcgccctccaattgatcggcccgccgcacacggcgcgggcagttgccgccgaatggcggccgcaaacggcaacgctgtttgccctgcgcatattatagcacaagctgtgtcgaaatccaacccttttgcgtcgtcaggcgggatttgtcaaaagcacgtccaaattagggtgcgttcacacaatccgaaatgcccagattgtgcggtatttttccaaatgccaagagccgtctgcgacggctgcatttggacgcacctgcgggcacagtatatcaggcaaggtgcagcggcgcaggaatacttaccgtatttcaaggagctgcagcgcagcacagtgcaagaaggctggaaaagcgggcgctggcaaaatccacgccagccgcgcggcgtctgtcatggattttgctgggggcaggcggcgctccgccgcaggtgtcttgcggcctgcgggccgcgctttttatgagggctgcggcccggggtttaagggcgctgccctcgaaaaaaggcaagacccgcgaggggccttgccttttttctcacccgccgcctcccccaaaaggcgggcgaaaacttttgatcgacgcggcgtaaaactaattatgcagcagctaccccactattcgcggcgcagcctgtataaacgcagtgcctaacccactattcgcggcacagccggctaaagttttttgccgaggctttttttcaaaaaagccggagcacagcctgtatatgcgcagtacccgccctactattcgcggcgcagccgattaaagttttttggcttacctttttttcaaaaaaggtaagtttcaaaaaagcgggaggacgcagacggcgcggacgccgtagcgccgcagggccgcggcggtgccgccgtcgatgcgctcgccgggcataacgaccgggacgccgggcgggcagggggaacaatcgcacgcggcgacgcggcccgcgcagttttccacaggaacctgctcgcgcggggaaaacagcgccgcgcgcaccgaaagcgcccgttcgggcagctttggcgccgcaggcggcgcggcgcggcccaccggcggccgcaggccgtcgagagcggcgcgcagccgctcaaaatcacgggcgtcgttttctccgtccgccatcaatacgcaggcgctcccgctgatatattccggctccacgccatagccgcgcagatgcgcgccgaactccccggcctgatcgccgcgcgctgcgaaacagagcgacagctttgccgggtcggacaggccgagcggtaaggcaaaccccttttgcagcgcaaaatggcgcagcgcgtcaaaggcgcgcgccgtgcgatcaaacccttccctggccgcaccgccggccgcataagccacggcccgttcacaggaaagcataatcggatagcttgggcttgtcgaaccgaacaccgacatcatgctctttgcgtccccggcaaaccgctcctgcgaaatatgcagcagcgcgccgcccgtcatcgcaggcagcgtcttatgcaggctgtcggcgcacatcgaagcgccgcacgcgattggatgcatgtttccgtaccgttccggcaaaaaaggcaggtgcgccccgtgcgcgttgtccaccagcagaggcaccccccgcgcgcggcacaccgcagaaatcgcagccacatcgctcataacgccaaagtagtcgggcgacgtgatataaacggccgacgcctccggatgctcggccaaagccgcttcaaccgcctggggcgtgtaccggccggaaaaccaggctccggcgctgccgtcaggcatcacccatacaggcgtaaggtcaagcagggccgccgcattgattgcggcgcggtgcacgtttctgcccatgaccaccgtcccgcccgcgccgcacgcaagtgcaagcatcgtctggatgcagagcgtcgcgccgcccgcacagagcagagtgcgccgcgcgccgtaaacctgcgcggcaatgcgttcaaacgcatcgatcgcctctccggcatgatacaggctgtccgcgcccgctacctcggtgatatcccacggcaggatttctgaaaatggcggggtcccccttcccttgtgtccaggcatatgaaaacgcgcgcggtcctgttcaatatacagccgcatggcgtcatacagcggcgtattcatgagcggcgcagcttctttttgagctgcccgagtttaccgttcagatcgatcgcgcgatcaaccagctttgccttgatgggtttatacgtgtaatcgaattctccggccaattcgtcaagctgaccgttgaagccgcgcttaaactgataaagtcccgccatatgtccgccctccaaatcgcccgaaacgccctggaaatcatacacctcgcagccggtctgaacagcccatttgatcatttcccactgcatcaggtaatttggcatgacatcgcggtggacgttgtccgacgcgccgtacacgtagcagcatttgcccgcgtaattcgtcgttacagcgccgcagacaggcgtcccctgataaaagcccatatacagccgcacatgctctccgagcgcatccagcatccgctcaaaatatgcccgggggcgtacattgaacccgtcgcgcgcgccggttacacgcataatgcgcacaaattcatcgaggtattccggacccaccggtcgcacctgcacgtcatttttaattgcgatgcgcaccttgcgccgcgtcccctgcgtcaggtttgcaaacagctcgtcctccgtgcgcccgttcaggtacaagcgataattgaaacgcgcctgaatgccttcaaagccgtccgggccatagctctgcacaaaccccatatcctttgcgatcctgataaactccgcatcgctcataagaacatccgggtccattttaaacgcatgcgccctatactttttcgcgagcgcgtcgacgccggccttcagatcggccagcacagccctgtcatgcaggtcgcacacaggcccgcgcggcgcgtacagaaacgacgtgccgatcaacggaattttctgcaccagcaccgatacggcgccctgtattgtcccgtcggccgttcgcgacacaaccgcctcatatccccagttgtttttgaccttctgccaattgacgctttgtgtaaagcatccctgcggatgcgccgatacaaacgcttcaaattcgccgtactgctccggcgtcaaaatctccatactgtttcaacctttctgacggcggtctgcctgccccatctttttacgtccgccctgcgggcgggctgggccgggcgtccgtgtccatatcgtcccgcgcatccccgcaaatgatctccaaattgcgcagaagcaccggcgtcccccgccagccatacgccttctccccgcacaggcgggctgcattgtcggcgtgcacaaccggctcgggatgctcgtaaaacgcgggcacacggcttttctgagccagacggttcaccggacacgcgtctgtacaccggtcgcagccccatacgaaaccgccgctgcggatctgggcgcgctcccagccggtcagcgccccctttttttgcgtgatgtgcgagcggcaaagcgcacggtcaaagccgtccgggcgcagcgcacccgtcggacaggccgcgatacagcggccgcagcgcgtacagagcggcgcggcgcgccgggacggctcaagcgccgccgtcgttacaatttcgcctataaagcacctgcttgcatacgtccggttgagaagctggccgttcatgccgatatctccaagcccggccagacaggcggcccgaacctccgccaccggggacgcatcgacaaacggtacaaactgctcgtccgcatacagcgcgcgaagcttgtccgcggccgtttctagcactgcgcgcacaatggtgtgataatcgtcaacaattgcataataggatatattgcgattcggaaaatcacctatataatatccaaacagaacgacaatcacgctgcgcgccccctgcgggatacgcgcttttgaacgcacgggaagcagcggcagcgcgtcgtgaaagcggcagacaccccattcgtcgaacgccataccgcgcatgagcgtttcaagccggctgttcatgagggctgttcaagatcaaactttcgcatcagttcacgcaccacggtgtttgtacaaacgacaagcaggcggtcgcccgaaagcacctgcgcgttgccgcgcgggataatcaaacggccgtcgcgtgaaatggatacgacaaccgattcctccggcaggtccagttcggaaaggcgcgcgccgctgcgccggtaatccggcggaatctgaagctcggaaagcgacgcctccccgcggttgagcggcatgagctgccggatagcggccgcgtccacctcgcgctctaacaggcgcgcgatattgtccgtcgcggaaatcggtatatcaacgccaagctgtttcatgaccgcggcgtttttggggttgttgatgcgcgccaccgtgcgctggatgtggaaaagctgctttgcaagctggcaagcgaccagattgtcctggtcgcgtccggtgactgcaatcagcgcgtccgcatcctttgcgccggcgctttccaacacatcaagcgtgctgccgtcgccgcagatcaccgcgacgtccagatcgtcagcgatccgcgtgcacagagcgcggtctttttcaatgatgtgcggcctgtgtccatgctccagcagcgtcttagacagataatagcccaccttgccgccgcccacaacaatgatctgcattcaaagccacgcctccctgtcaatcgattaccctcgcgtacagcagccggtcgttcggtccaaccggctgccgcgagccagcatacgccaatgtgagattgccgtcctcatgcagcagcccaaacaggacatgatgcgcgtcgtcggcgccgcaaagcgccccaagcgtcatacccacctgtttggcgtccggctgcctggtgtcaaaggagacggttgctgaatcaagatatacatttttgatctggtcccggcccgttagcatcgcgtagatcgcgtcaaccgacaggtttgtcgggcagactgtcggcagtccaaactgtgagaacacatcgccgcgcctgggatcaaaaacgcgcgcaagcacgcgcggcacatggaatacctcgcgcgcaagctggcagaccatcacatttgtattgtcgtcctctgtgaccgcggccaacgcgtcgcacgcctcaatacctcctctgcgcagcaccgtctgatcgatcggcacacccgccacggtatagcccctgaaatcgtcggacaggcgttcaaagctcgccgggtccggatcgatgacagcagtatcgtgccccatgcttgataaaatatttgaaagctgcgaaccaaccttgccgcagcccacaacaagtatattcatctggatcgctccttgtaaaaagccctatgcggggccgctttgccaacagacaaagtatacaccatttcaccggcgttgcataggggaaaatggcgctccccgcgtaaacggttgaaaatccgcctctgttggagtacaataggattcgaaagcatccggccccaccgctggatcaaacgcgcgggcggcgggaatgtaaaagccttatgaaatccgtgtgcgcagcgttgaaatggaggaaaaccgatatgagcaagctgattgacgccaaaggaaaaaactgccccatcccggttgtgatggctaaaaaggaaatcgacggcggcctgtccgcctttaccatcgaggtggacaacgcggccgctgttgaaaaccttcagcggctggcggacagccaggggttccggaccactgtgcaaagcagcggcggcgtcttttccatcgatttcaccaaggccccgtgcgagccgtgcgccgcggccgacgcggtgatccgtcaggaaccgccttccgggaagtggtccgttttcgtcggccgcgagatcatcggcgacggcgacccggaacttggcgcgtcgcttatgaagatgtttttttacacgctcacacagtcggacgacctgcccgcctccatcctgttcatgaacggcggcgtaaaacttcccgtgcacaacgggcagattgccgagcacctgcgggagctgtcgtccaagggcgtcgagatccttgtctgcggcacctgcctgaatttctatcatctttccgaacagctccaggtcggcacggtcagcaatatgtatgagatcgtcgagcgcatgaagcaggccggcaaggtgatttccctgtgaccggttacggtgtgatcgcctttgaatcgacgcacctggccatgcaggccgaacgccgcctgcgtgcatccttctcaatcgcgatgatgcccacgccgcggtccatcacggcctcctgcggcatttccgttcgtttttccctcgccgatctcgacgccgtcgccgatgcgatgcgctccatcggcccggacggcggctggcagattcattgcctgtgatttgcttttttgcacagtatggcccctgcgccgccgcgtttgcggcggcgcaggggccaattttataaaccggcctgcctttatgcctgcggcagcgtaaagctttcgtcgatgcggaaggtcgcagcgacccggcgcgcgatatcgtcgacggccggcgtcatcccctcgccaaaatcggttgcgtaaacgatgaccgggaaacgcagccccatgagaaaataggccgtttgccgcgctgtacggccgtcgtccgcagcgcggtcaaacgaaacgacataagctgtggctgccgcaccgttccaaatggaataggccacgttctcgggactgcgcggcggcaaatagtctgcttcaataaattcaaagaaactctcccaaacggcgggatcggcataatcgacgccctcctgcggttcggtcggcatgatctcaacaacaacgttcgacggctgcgacgcgatgtccacggacgcatccgtaaagaacatggcggtatacgaacccatgtcgctgtattccttccagccggccggcagttcaaaggtgaacgggccgcttgtaaagatctgcgtctcccaggaggcagccggggcctgggaatcatcaatctcgatcgtagcgcctgcgtccgcgctgccagagccttccggtgcgccggccgcctgcgaagcggcgtccgcagcgcgtgaggaagcggtttcgtccatgcttgaagccgcggcggacggcgcaggcacatcctcggccgccgagggcgccgttgccgccccgcaccctgccgtcaaaaaaaggcaggcggtcatgaaaactgtcagcaaacgtttcatttcacattctcctgttcttttttccactctctgtattcatcatatgtcattgtacgatctgtaatagttccgtccatatgaatttcaatgattcggttggcgatcgtctcaatgaattgatggtcctgcgatgtaaacagcacgattcccggaaaatcgaccaggccgttgttgacggctgtgatcgattccagatcgaggtggttcgtcggctggtcgagcagcagcacattcgcgccggtaagcatcatgcgcgaaagcatacagcgcaccttttcgccgccggacaacaccttgacgggcttatacacgtcgtccccggaaaagagcatccgccccaaaaatccgcgcataaacgtctccgtatcatcgggtgaatactgcgcgaaccattgcagcatcgtcagctcgctgtcgttaaagaaggcggaatgatcctttggaaaatacgcctgcgaagttgtttggccccatttgaaggtaccggcgtccggcttttgctcctccatcagaatgcggaaaagcgccgtctgcccctgttcgttctcgccgacgaacgcgattttgtcgccgcggttgacacggaacgtcaccccgtcgagcaccttgacgccgtcaatcgtcatggtgatcccgtccgtttcaaggatctccttacccggctctcggtcgggcttgaaggcgacccacgggtaccgccgcgacgagaccggcatttcgtcgaccgtcagcttctcaagcagcttgcggcgcgaagtcgcctgtttcgatttcgatttgttcgccgaaaagcgcgcaataaagttttgcagatccttgatctggtcctcgcggcgtttgctttgatccttcataatctgctgcatcagcctggacgactcataccagaaatcatagttgccgacatacatgcgcacctgattgaaatcgatgtctacaatatgcgtgcagatggtatttaaaaaatggcggtcgtgcgacacgacgatcaaggtccccggaaaatcaagcaggaaatcctcaagccagtcgatcgatttgatgtcgaggttgttcgtcggttcgtcgagcagcaggatatccggctggccaaacaatgcctgcgccaacaaaaccttcaccttgtcgccgcctttgagttcgcccatgggcgtgccgtacagctcaggcgcaatgcccaacccctgcaaaatacgccccgagtcgctttccgcgtcccacccgttcatttcggcgaactcgccttccagttcggcggcgcgcgcgccgtcctcgtcgttaaaatccggcttttcataaagcgcgtctttttccttcattacttcatacaggcgcggattgcccatgatcaccgtatcgatgaccggatattcatcatattgaaattgatcctgcttaagcaccgacatacggcattttttcgggatggaaatttcgccggtggtcggttcaagctccccggagagaatttttagaaaagttgattttcccgcgccgttggctccgatgatgccatagcagttgcccggcataaactttaaatccgcgtttgcgaacagttttgtacctccaaacatcaggcttacatttgtgactgttatcatttgcagctcctgttaaatcaaataaatttttattctgactttcgtgcaggataaagtataccatgttttgacagcgcacgcaatggacagaaagcttataattgccggctgcgcgcaattttccaaaaatagataccaattgcaaagaggaagaatacggaaatccactgcgatgttgagaagaacaggaaatggccgcgcacggcgtcgccgcgccaaaactccagcaaaaaccggacgcaggcataaagcgccgcatagagaagcaatgcgccgccggtaggctgcctgccgctaagacggcgctcacgcaaaagcaaaatcatgcagatcgcaagattgcaaaccgcctctgcgagctgaaccggaaacagtggcacgccgttgggcgcggccagcgactgtttatagacgacgccccagggcgcttcgactccccagcagcaaccggccagaaagcacccaatgcgcccaaaaacatgaaacagcggcagcgcgggcgcataaaagtccgccgcagcccgcaggctgatccggtaacggcggcaataagccgccgccgccaaaagcccgccaatcaagccgccataaaatacataaccgccggaaaaaagcaattctatcgtccgataggaccaatcgatttctgtcgcgcgccgcagcagctccggagcgattatgatcagataaagcgcctttgcgccgatcatcgcgccaatcgtcccaagcaacaggatatggagcgtatcatccgatgcaaagcggaaccgtttacgtctggcgtataaaaggaccccggaggcgagcaggcccaacatacacatcagccaataagacgggatcatatagcgagcaatttttataaatggcatcatttcatattccctcaaaagaaaacaggccgcatttacggcctgtttcaaaataatccgttatcaaaagccgcattgcaaaatcaacaagcgattcgcctaggcttatctgacaggatcttatccaagtgcgacacccatggaagcaaatgcgccgatacacagtacacatgcgagcagccaaagcgtggaaagaacaagaccgataattgaacagatcataccggccgtagccaatccgcgcccctgatcaggggcaagctccttacgcgcgcccacgcctaaaacaatgccaatgatgcttaaaattattgcaagcagtgaaccataaccgaaccaaaccacgaccaaagaaagaataccaagcaccagagaggctacccctttgtttttagctgaattgttttccaacatcctcactcctcaaacaaattatgtttataataacataatctatatatagtgtcaacaattttccattattttcgacatcagtacaaaaaaagacttcgctataagcgaagtcttttatgctggcaaagacctatcttcccaagcagtcacccgccaagtattgtcggcacaactgagcttaacttctgtgttcgggatgggaacaggtgggacctcagcgtaataaataccagctattgaaacgacatatttcaccgacgagagttttctcccgtatcgcctgccgcaaggctctgtatatcatcctccgccatccggcggtcagttctcggaaacctgccatagtgatatggtaaggcgccgggttcttaccctactttactgttcggtatcgcctatcccgtttgcaacaatgacgaaccgggaatgggggcagataggaaacaactacctcaaatccctgttcgctatcggttttcaaggcttcctcattatgatatgcgtcggcatttacgcggttctggtaaacaacatgataatagcggacaatctgcacagcgcgatattctcccttgcagcctataccgttatcctctgtttctccctgttcaaatccggcgcactggcgaagtcgatattctccgcgcattagcggcgtgtcaagggcagggtggagattttcagagcgaagcggcgaaaatacgacccgaccttgacgcggataacccccatataatacgggcgggcaaagggcatagattgacctttgccttgattacccttatgggaagttacagcaacaccaaacccagagaaaggaggttttcacttggcgtatgtacccgtacccaaagacttatccaaagtcaagacaaaagtagcgttcaaccttaccaaacggcagattgtatgttttgcggcggctctcctgttcggcttgccgcttttctttctgctcaaagacagcacaggcacaagccttgcgtctatggctatgattgccgtcatgctgccctgtttcctctttgccatgtatgagaagcatggacagccccttgaagcggtggtgaagaacatcattcagacgaaattcatagcccccaaagaacgaccatacaggacagacaacttttattccgtcttagaacggcagagaaaacttgaaaaggaggtatcagcgattgcaaaaggaaacacgaagaaacagcgcggcgggaagcgcaaagcctaacccgccccgcaagctcacccgcgccgagaaaaagcagattgcggaaatcatcagacaggcaaagggcgacgggaaagcgcacaccgcgcagcagacaatcccttatatccagatgtacccggacggtatctgcaaggttacgggacggaaatactcaaagaccgtcgcctttgaagatattaactatcagcttgcacaggcagacgacaagaccgccatttttgagaactggtgcgacttcctcaactactttgacgcttccgtttcggtgcagctctctttcatcaatcaggggacgcagcgcggcgaagcggaaaaggcggtcaatatcccggcacaggaggacgctttcaattctatccgcacagaataccgggatatgctgaaaaaccagcttgcaaagggcaacaacgggcttgtcaaagcaaaatatatcacctttgccattgaagccgacagtctgggcgcggcgaaatcccgccttgcccgtatcgaaacggacgtactcaacaactttaagctcttgggcgtgtctgcccgccccatgacaggctatgaacgccttaaaatgctgcatggcattttccacccggagggcgggcagtttgcctttgatttttcatggcttgccccgtccgggctttccacaaaggactttatcgccccgtcctctttccgttttggcgaggggcggtatttccgcatggggcgcaaaatcggcgcggtttcattccttgaaatccttgcgccggaattaaacgaccgtatcttatctgacattctggacttggaaacgggcgttatcgtcaatctgcatatccacagtatcgaccagaccgaagccataaagacaatcaagcggaaaatcaccgaccttgacaaaatgaaaatcgaagaacagaaaaaagcggtacgcagcggctacgacatggatataatcccgtccgaccttgccactttcggcagcgaagcgaagaacctcttacaggacttgcagagccggaatgaaagaatgttcctcttgacgttccttgtggtgaacatggcagacacaaaaaggaaactggaaaatgacgtattcgcggcggcgggcattgcacagaagaacaactgcgccttaacccgccttgactaccaacaggaagcggggcttatgtcctctgtaccgcttggggagaaccttatccccattcaaagagggcttaccacgtcaagcaccgctatctttatcccctttatcacgcaggagctttttcagacgggcgcggctttgtactatggcttaaacgcccttagtaacaacatgatactctgcgaccgcaagcagctaaagaaccccaacggcttaatcttgggtacgccgggaagcgggaaatcctttgccgccaaacgggaaatgacaaacgctttcctcattaccgacgacgacataattatctgcgacccggaagcagagtatttttcccttgtgcagcggcttgacgggcaagtgatacggttatcgcctacgggcaagggcattgacgggaagccccagtatgtgaaccctatggatattaacctcaattacagcgaggacgacagcccccttgcgctgaaatccgactttatcctctccctctgcgagcttgtcataggcggcaaggagggcttgcagcccgtcgataagaccgtcattgaccgcgctgttaggaacgtgtaccgccctttccttgcagaccccgacccggagaaaatgcctatcttgggcgacctctacaacgagcttttgaagcagccggagccggaagcggcgcgtatcgcggcggcgttggagctttatgtttccgggagccttaacgtctttaaccacaggacgaatgtagagctttcaaaccgccttgtctgctttgacatcaagcagcttgggaagcagctcaaaaaattaggtatgctcattgtgcaggaccaggtatggaaccgcgtcaccgtcaaccgggcagaaaggaaatccacccggtattttatggacgaatttcatcttctcttgaaagaggaacagaccgccgcctattccgttgaaatctggaagcgtttcagaaaatggggcggcatacccacagcaatcacgcagaacgtcaaagatttgcttgcttcccgcgaagtggagaatatctttgaaaactctgattttgtcctcatgctcaatcaggcggcgggcgaccgggctatccttgcaaagcagctcaacatctccccgcagcagatgaagtatgtcacccacaccgaagcgggcgaggggcttatcttctacgggaacgtggtgctgccctttgtagaccgcttcccgaaagacaccgagctttaccgggtaatgacgacgaagccggaggaagtgggcgaagcatgaacgggctgaaaactgacacaatcatcaaccgggacgcgctctatgccttgcgggagcttccagaggaaagcgtacactgttgcgtcacaagcccgccctactatgcgcttagggattacgggcttgatatgcagattgggcgggaggacacgccggagcagtacattgacaggctgaccgaggttttccgcgagctgcgccgggtactgcgttctgacggtacgctctggctgaatatcgcggacacctactgcggcacaggaaataaaggctaccatgcagacccgaagaacccgaaaggcagaaacggacagcagattgcaagaaacaaccgcgtttccggctgcaaacaaaaggacttaatcggtatcccttggcttttagcctttgccctacgcgctgacgggtggtatttacggagcgacattatctggcagaaagaaaaccccatgccggagagcgtgaaagaccgccctacccgctgctatgaacatatctttctgcttacgaagtcaaagaagtatttttatgacgcagccgccatagccgagccgttagcccccacaacggcggcgcggtaccgcaccgggcgcagcgcgggacagaaatatgcggacgaagtacccggacaggggaacgtacaggggcttaaccgggcgcgaagcggcagctactacgacgaagccctcatgccgaccatgcggaacaggcgggacgtgtggcttatcaataccgttccctacaagggcgggcatttcgccgcgttcccgccaaaacttgccgaaacctgtatcaaggcgggctgtccgaaaggcggcgttgtgcttgacccctttttcggcagcggcacgacgggggcagccgcaaagcagcttgacaggcattatataggcattgagataaacgccgagtattgcgcccttgcaagggcgcggattggagggacagacacataaaacaatataaggcgcgtgaaaaagtcacgcagaaaatgacccgcgagggggctgtcgaggtaaacgccgctaccgggaaaaagaaacgtatcagcaagcggataagggacgcggactttgcaaagaccgaagccccaccgcagccggaacaggcagcgcagcccctaccgggcggcgcaacttccccgcccttaaccgacacgccgccgcttccccatgcgccgggggcagaacgggaacaggacaccgcagcagccgagcgcgtcttggaacgtatcgacggggcgcgtaccagaaaggcgagcaaaaaggcggcgaggaaagcacaggcagaagccacagcaaaagaaaaatcttcccgcttgcagtttaccgacgaggaacgggcaacgccggagcttgaaaggtatatccgaaaatcggacaaagcagccgaccgtctggacgcggcaaaggcggctatccccaaagaaaagaaacttgtacgggagcgcacctttgatgaagccaccgggaaaggcaagacccgcctacattttgaggaacaggaaaagcccataggaaagaataagccccacaataacccgctatcccgccccgcacaggaagcgggtattttcgtccacaacaagatacattccgttgaaaaggacaattccggcgttgagggggcgcacaaatccgaagaactggcagagcgcggcgcaaagtacggggcgcggaaagtcaaggagggctaccacagccacaagctcaaaccctaccgggcggcggcaaaggcagagaaagcggcgttcaaggcgaatgtggattttcagtaccataaagccctgcatgacaatccgcagattgcgggcaatcccctttcccgcttcatgcagaagcagcaaatcaagcggcagtatgcaaagtcggcaaggaaaggcggcgcaaaaacggcgcagaaagccgcagagaacacccgcaaggcggcaaaaaagaccgccgaggaaacaaaaaaggcaatcgcttttgtagggcggcacccggcgggcgtatgtatcgccgttgccgcgctactcttattcatcatggtatcggcggggctttcctcttgcggttccatgttctccggcttgatgaacggcatacttgggacttcctacacgtcggaggacagcgaccttgtggcgacggagaacaattacgccgcaaaggaaaacgagcttcagcagcagattgacaatatcgaaagcacccaccccggctatgacgaataccgctatgaccttgacagtatcgggcataacccccatgagttagcgtcctacctcaccgcccttttacagacctacaccccgcagagcgcacaggcagagctaaatcgcgtctttgccatgcagtacactttgacgctgacagaagaaacggaaatccgctaccgcacagaaacaagcacagacccggaaacaggggaaacgaccaccgaggaagtaccctacgagtaccatatcctcaacgtgaagctgacgaacaagcccatttccgagattgcggaggaacttctaacgccacagcagcttgaaatgtaccgcgtctatctggaaacaagcggaaacaaaccgctgattttcggcggcggctcccccgatatgggcgcgtccgaggatttaagcggcgtacagcttgtaaacggcacacgccccggcaacaccgccgttgtagaccttgcgaagcggcaagtcggcaacgtgggcgggcgacccttttggagctggtacggatttaacagccgcgtggaatggtgcgcctgtttcgtttcatggtgctacaatcaagccggaaagagcgagccgcgctttgccgggtgccagtcacagggcgtaccctggttccagtcacgcgggcaatggggcgcgaggggctatgagaatatcgcccccggcgacgctatctttttcgactgggacggggacgggagcgcagaccatgtggggcttgttatcggaacggacggggagcgcgtctataccgtcgagggcaattccggcgacgcctgcaagataaagagctaccccgtcaattactcctgtatcaaaggctatgggctgatgaactggaattaacatatttttgagcaaagaaaggagaaatttattgatggctatgaacaaaattgaacgtatcgacaaagagattgcaaagacccgcgagaaaatcaccgagtaccagaacagattaagggggcttgaagcgcagaaaaccgaagcggaaaacctgcaaatcgtacagcttgtgcgctccatgcgcctttccccgcatgagctttccgctatgctttccggcggcggtattccgggcatggaagccgcgccgggctaccccgcagaacccgcagaccacgacaccgaagaaatggaggacaccgagaatgaataagaaaatccttagaaccttgaccgcactctgcgccgccctcatgctgacgggcggcttttccgtcaccgcctttgcacagaccccggagggacaggacgcgaccgacgacagcggcgttgtctatgaggaacccgaaaaggaagaaccccttaccccggacgggaacgcgacccttgtagacgatttcggcggcaacaagcagcttatcacagtgacgaccaaaaacggcaattacttttatatccttatcgaccgggacgacgagggcgaggacaccgtacatttccttaatcaagtggacgaagccgaccttatggcactcatggaggacggaagcaccgaagcagccccgcccgccgtttgcagttgcaccgataaatgcgaagccggaaaggtaaatgtgagctgccctgtctgcaaggacaacatgaccgcttgcagcggcaaggaagcggagccggaaaccgagaaaccaacagagcagcccaaagagaaaggcaatacaggcgggcttgtgcttttccttgtcgtggcacttcttggcggcgggggcgcgttctattattttaagtttatgaagccaaagcagaacgtcaagggcgacaccgaccttgaagatttcgattttgacgattacgacgaggacgagggggacgggctttctgatgaagaacaggaggacgaggaagcatgacgctttttaccgaaaaccctttagaaaaaatgatggtacaaagacccaccgggcggcgtgacagtgcgccgcccgttccaaaatccccggcgtgtatgcgttgcccttataaggcgcaatccccctgtatcggctattgtctgaaacaggcacaggagaagaagcacaccgcgccggaacgctgaaaggaggattttttcatggcatttagacttgtgattgcagaaaagccgagcgtggcgcagactatcgccgccgcgcttggcattaaggggaaacaggacgggtatatcgagggcggcggctacctcatttcatggtgcgtcgggcatttggtacagcttgcggaagctgccgcctacggggagcaatataaaaaatggagttttgacagcttacccattctgccggaggaatggcagtacgccgttgacccggacaaggggaagcaattcaaaaccattaaagagcttatgcaccgcgccgacgtttccgaagtggtaaatgcgtgtgacgcggggcgcgagggtgaattgattttccgctttgtctacgaagtggcgggctgcaagaagcccatgcgccgcttgtggatttcttcaatggaggacggggcgattaaggcgggctttgcttccctcaaagacgggcgggactatggcgcgctctttgcgtccgccctctgccgcgcaaaggctgactggcttatcggcattaacgccacccggcttttctcctgcctgtatggaaagaccttgaacgtggggcgcgtccagaccccgaccttaaaaatgctcaccgaccgggacgcggctatctcccatttccagaaagaaaaatattatcatgttcgccttgatttatccggcgcggacgcggcaagcgaaaggatttcggacaaggcagaagccgacgcgctgaaaggggcttgcgaagcgggaaaggcggtatgcgtttcccttaccagagagaagaaaaccgcagccccgccaaagctctttgaccttacctctttgcagcgggaaacgaaccgcattttcggttacaccgcaaagcagacccttgaccttgcacaatccctttatgaaaagcggctccttacttatccgaggacggacagcagctttcttactgacgacatgggcggcaccgcagcggacattatcgcgctgctctgcgaaaagctcccctttatggcgggcgcggacttcacgccggagattgcaaaggtattagacagcaagaaagtatcagaccaccacgcaatcattcccactatggagcttgcaaaggctgacccggacgcgctgccggaaagcgagaagaatatccttacccttgcgggggcgcgtctgctttttgccaccgccgagccgcatatttatgaagcggttacggcggttttctcatgcgccgggacagacttcaccgcaaggggaaagaccgtacttgcggagggttggaaagagcttgaacgcagataccgggcgacgctgaaagataagcccgaagcagaggacggggaaaatgagggcgtgacgctgccggagctttccgagggacagaactttcctaaccccgccgcaaaagtaacggagcataccacaacgccgccgaagccccacagcgaagcgtcgcttctctctgctatggagcgagccgggaacggggacaccgacccggacgcggaacgccgggggcttggcactcccgccacccgcgccgccgtcattgaaaaactggtaaagggcggctttgcagagcgcaaggggaagcagcttatccccacgcagaacggagccgcccttatatcagtcttgccggatatgctcacttccccgcagcttaccgcagaatgggaaaacaatctgacgcagatagcaaagggagccgcagaccccggcgaatttctgtccggcattgaagctatggcgcgggagcttgtgcagacacacgccgcagcactggacgggaaaaaggatttgttccgggaggaaaagccctctgtcggcaaatgcccccgttgcggttcccccgtccatgaggggaagaaaaactattattgcagcaacaaagaatgtgcctttgtcatgtggaagaatgaccgctttttcgaggaacgcaagaccgctttttccgcgaagattgccgccgcgctccttaaatccggcaaagtgaatgtgaagaagctctattccccgaaaacaggcaagacctatgacggaactatcgttctggctgacactggcgggaaatacgtcaactaccgtatcgaagtacagaagaactaaaaacttgaatagcaagcataggaagcgggtacccacttccgtaaatccctgtcctgccgctgacgcgccggacggggattttgcttgttgggaagtttcccaaaccctctaaaaaaatgaaaaaattgttggcataacgcacagcccaccgtagtacggggcgaaccccaaaagcgcggcggtgcgccgccatttcagaaaggagcgaatgaatggaaaagaaaaaaggttactccatgtttgagcgtgacaagttagacccggctgacagtatgcggatagagcgaaatatttattttgaggaacagaccgctgacctttccgggcttaccgccctgcccttagaacagttacaggcattgcgggaagaatacgcggcggctgaacaggcagcttttgaagccttgcaagaacaggcggcggcatgggacgaacaggcgggaaagacccttgccattgacaaagccattgagtatgtgaggacacccgaagctacgcataccgcgaaccagtgggaagctacggactacgggaagcacatcagcaaccgcgtctaccaaatgcgctaccacatatccgagaatacccggtatgacagggaaaaagagaaatccattccctattcgtggacgctttcatggagtatttacaccaacagcccccacaattacggacaggcaaaaatcgccggacaggaaaggaaagtctttgcagacaaggcagctatggaaaaatatctgaatgggcgtatcaaagcctatcagcatttattcaccgaggtatcgccgcctatcccgccagagtatgcagagcatttcaaagtaaacgggcagcttttaccgggctatgctatcgagggcgaggaacgggcgcagcctaccgctgaaaaagcagcccccaccacagcagagccgccacaggacaccgaacagagaaaggagcgtgaaaccataaacgagcagttttcaattcttatcgacagccgcagccgctttgaaacaggcaaaccgggcggcgtgtggcttcccatgccgaccacaacagagcagcttcatgcggctatggaaagcgtcggcattaccgcagacaatccgcaggattttttcatcaacgggtattcttctacggaggactgcccctttgacttgccgctttccgttatccaaagcgcaagcatggacgagctgaattattttggaaaacttctggaaatgcagagtgacggggacaaggataaatttgcggcggcggttacacatggcgagtatgccggaagcatgaaagaccttatcaaccttgcacaaaaccttgactgttactggctctatcccactgtccgcagcgaagaagattacggttattatcttatcgacgaactggacgagctggagcttcccgaagaagcaaagaaatatttcaagtatgaagaatacgggcgggacgcagttagcaaggataaggggcagtttaccgaacagggctatatctataacaatcagaacacctttaccgaatggtatcggggaacggaaaacgagatacccaaagaataccgcgttatgagcttcccacagccggaacgcggcggacaggacaagacctttatggacgcagccgccacagagcagaccgcccgaaccgccgcagagcagccacaggagccgcacccggttatccctatcgtgctgacagccgggaagcccgccgagaaattaaaagagattaccgaccgtctggaacagggcattacggaactctttgacagcgagcgttacaaggaatatctgaaagtcatgtcaaaattccataattacagcttccgaaacaccgtccttatcgccatgcagaagccggacgcttcccttttggcgggcttttccgcttggaagaacaactttgagcgaaatgtgatgagagggcaaaagggaattaaaatcattgccccgtcgccctataaaatcaaacaggaaatgcagaaaatcgacccgcacacgcagaagcccataatcggcaaggacggaaagcccgtcaccgaggaaaaggaaatcaccatacccgcctacaaggtggtatccgtctttgacgtttcccagaccgagggaaaggaactgccggacattgccgttgacgaactgacaggcgacgttgaccgctataaggactttttcgcagcccttgaaaagacttcccccgttcctatcgcctttgagaatatcgagggcggctctcatggctactaccacttggaggacaagcgcattgctatcaacgagggcatgagcgaattacagaccttaaagaccgccattcacgaaatcgcccatgcgaagctgcacgacattgacctcaacgcgccaaaggacgagcaaccccgcgttgaccgccgcacccgcgaagtcgaagcggaaagcgtcgcctataccgtctgccaacattacgggcttgacacgtcggactattctttcggctatgtcgccgggtggagcagcgggcgggagctgtccgagctgaaaagctcccttgaaacgatacgcagcgcagccgccgagattatcaattccatagacgcgaattttgcggagctgcaaaaggcacaggacaaggagcagaccgccggacaggagcagcccaccagagagggacaagaagccgcgccacagccggaagccccgaaaaaagcagatacagccgggaaagaaaagccggaagcagccccgaaagaagcctttaccccggaaacgatttacagagtgcgccggaacccttacagcgacagccgggaaaacagccacctcttgcaagcctatgtgacacaggagaacgggcgggcgaaaatgggcgacgtgctttatacgggaacgccggagaaatgccgcgagcttatggggcagctcaaaagcggcgagctgaccgagggcgacgtaaagcagctttacgcaaaggcacaggaaacggcgcagaccaccggacaggacaaggacaccttttccatttaccagataaagggcggggacgaaacaagggacttccgctttgagccttacgaccgcctgcaggcggcgggaaatgtggttgataaagcgaactatgagcttgtctattccgcgccccttgcgccggaaacttcccttgaagatatttatacccgcttcaatatcgaccacccaaaagattttaagggacacagcctttccgtttcggacgtggtagtgcttcatcagaacggacaggacaccgcgcattacgttgacagcgtaggcttccggcaagtgccggagtttttacaggagcagaagcagcttaccccggacgagctgacaacgggcgaaacaatccagacaccgagggggactttccatgtgaccgccatgagccgggagcagatagaagccgccggatatggctttcaccaccagtcggacgacggaaagtatctgattatggggaacgggacgcgggcgtttgctgttgccgcagagcagccggaaaaggcaaaccccttgaagcatatcgaggacaccgtagagcagaacgacaacaactttgacggtatcatcaacaacacccctaccgttgacgaactggaagcaaaggttaaggcgggagaaacaatttcccttgttgacctggctaacgcggtcaaagccgacaaagagcgcggcaaggaagcgaagccggaaaagaagccctctatccgggcgcagcttagggctgacaaggaaaaggcgcagaagaaaaacgcaaagcagaaattacaggatttggaaaggagctgacccatgccgaaacagagtaaatttgagaacgtggatttgttcgcttccctcaatgcggttatgaagcagaacacaggcttttaccagagcgacttggagattgacaaggagattatcgcaaaggcggcggcaagcccccgcaaggaggacaagacccttttgtggttctgccgcccgtccgggacgcattgcttccgggagcgcgacgttttcctcaaagacaccgcgccccacaacacatggcgtttctacatggagcagacgagcgaccgcgtccttgcctatgcaatcgagctaacggggacggagcgcgggaaaatcaagggcaatctgtacgaactggactacgctaaacattatgagcgcgtcaaggaaaaggagctgcccgccgatacggtgaagctgatttatgagcatggggaacgggagatacccgccggacagtttttcaacggcaatcccgattatgagcttggaaagtttgaacgctttgaagccgtacccaacgacccggacgcgctgcaatcgctcttacaggaagaacggcgcagccgggagcagcttccgccgggggatttcaaggcgcatatcgccgcattgcgggacgggctgattgaaacggaagcgcggcgcattgtacgggaaatgaagcggcacgacacgccgaacagccccaacaagacccatttcatggtagagctttccccggcgttcatgcagcttgcagccacaaaggacactgaccgccttttctccatgctgccctacaagacccttgccttttccaaaatcgagggcagacatgggacgtatgcgctgattgacaagggggagaaccgggacaggaagataaggaagccccgcccctctatccgggcgcagcttaaagcagacaaggcaaagaccgccccgaaaaaggcggcggcaaaaacaaaaaatcacgatatggaggtatgagcatgattagactgactgttgaagaaacaaaccttttgagcatttacaacgagggcggcaagcgggctttgattgagaatgtcaacgccgcgctgccctacatggacgcggatatgcgggagcttgcaaagcgcaccctttccaaagtggacgctttgaccgaagcggaatttgcagagcttcccatttacgccgctgatgaagtatgaacggggttaagcggctgacgccgccccagagccggaaagtcaacgcccttgtgcgccggacgtgctgcaattatgataacgggaactgtatcttactggacgacggggacgagtgcgtttgtccgcagctcatttcctattcgcttctctgcaagtggttccgggctgcggtgcttcccgccgacaggctactctatgcggagctttaccagacaggggacaagaagaagtgtaccgagtgcggcgcgttctttgcgtcaacctctaacagtgtcaaatactgccccgtctgccggaagcgtatcacccgcagacaagctgccgagcgcatgaggaaaagacgcacccctgttacgcagtaggtgcggaaaatcccttgatttacagggctttccgggcgtgaaaatcggataggcgatactttatacctttacccccgaaaatggcgttctactgcgtaacattcacgaaaacagcacccataaaaagacagggcgcggaagtcatatactggcttccgcgccctgttctttttttgcctatctgacatttcccttttccatttcttcaagcgggaactgcgggagggcttctatcagcttctttgtgatagactggcgcatatcttcgttgatttcctgtttcgtgcttccgtctggctgtctgaccgctaccgtcgatagcctgtcgatttcgtccttgtagcaatccacgactttctccaccgcccatttctccccggcaacggcggcgcgtatggtttcatattccggcattttctggttttccatgctcaacgctcctctgctttttgatagccctatcatagcacagcggcggggattttgctatccttatccgcgttctgtttccttttcccgttccggctgtctgtctgcctgtaaaatgctgtcaatgttctgcttgataatatcatattcccggactttctttttcaattttccatagtcggcgtaaagggcttctttctgcgcttggagggcttcatactccgattgcagcgcggcgaggttcgggagcttcgcaatgcccgccgctttcagtgaccttacggcggcttcatggaggataattgcctgttcctgtccggcgcggtacttctccctgttccttgccttgcggtatgcgtcatagacaggctttgtcttttgataggtggaaacattcttgataagcaccgccatttccgcaagccgcttttcggcgttcttcaatgcgtctgccgcctgtccgctttccgctgccatttcctcaatccggctgactaaatccgcgtactgctcaatcttatgttccgtcaagaaattcattgttttagctgcctgtttcagattgtggattttcgcccactgttcatagcccttactctgcgctgccttgatactgttctcaatgtcgataagcagcgacacgccgcgctgctctctgggagctttcgccacctttgtccgtctgcccgctatccgttcccttacggcttcctctgtatagtctgcgccgagggttttaaggcgggtgaagcgttcctgtccgggggcgcggcatgatacatatttccccggctttatctcatagcccgccgcctgtaaccgcgttagcaattcctcaaaactggaaacttgggggataagcgcgtcaacagtggttttcagcttgcctttccaacttgtacccgtcttttctgcctggtactccgcatagctctttcccttgctgcccttgccggggacgacaacggacaagccattttcccggcacagcttgtcgctcatgttccgtatgccgtaatagctccttttgttggaattgtatttatggtggtctacaaagttcaccgcgcaaaaaatgatatggttatggacgtgtcctttgtcaatgtgcgtcgtgagtacatactcatgctgcccctttgttaccgcgtcggcaagctgctttccgatttcatgggctttctgataatcgacttcccccggctcaaaggactgtatcagatgaaaggctaaattgttccccttttggagtgcttgcgacagggtatattcaaactcaatatctgccgtttcataggagcaaccgaaagaggacacaagcattttcccgtccgtcttgtccgggttttcgatatagtcaagggctttgcttagagtgcttttaataggcttaatctttgtaaccgccatatctccgcaagcaccccctttatttcctctatgtcctcttggtatgcgttccccgtcgcgtttacgcggcgtgctatctggttgacgttgacaccgattttctgtatctctgcggtcatagcctttatatcggcgtggtctatctgaatgatatacccgtcaatggcaatcttccgcagatacgccgccatgttccgggtgggtacgagcttcattttttccagtattaaatcccgttccgcttccgtcactctgaatttgatttgcactgtccttttgcgtccgtccatgtgttcgctcctttcctttccgttccgagggtttgggacacttcccaacaagcaattttcaaccgacgcgccgcagcgcgggagggcgaaaatacggaagtggtacccgcttcctatgcttgctacgaatgtttttatcctttaggctcttatcacctactacggagaaaaagcgattttgccaaacttacgcaaaagaaaaacgctgcaacctcaaaaaagattacaacgctttctaaatcctgttcagttttaagtcggacattcctattcgccctctttttcgacttcggaaatctcctttgccgttgcggttacaatccgtatgcctgtatcgctcataccgtcaagaagcgcgtcaagctgccgccgctgcgtgttcttctccggcggcgtttctaaaaggaattggtctacggatatatggtaacgctgtatcagctcaaagaatatctgtaaacttgggtgctgccccttgttctcaatgttcgcaaggtagcgcggcgagataaacatttcgtcgcctactttcttgcggctctccttgcatccctcacgcgctgcctttatcgctgccccaaaagccttaaagtcgtatcgtggtactggtctttttgccatagttattcaccctattacattttactgttcccctttcttcttggatatgtctacgtagttctatcagttagccaaaataattcatatatatatatgttgacaacaagctgcttttgtatataatattatataaaagggggggaatgtttatgttacatagcatgcgtattcgataagcattgaaatcaaaaaagatttttcccattttcaatatgggcttttttgtcatgcttattttgcgtatgctatacaacaaaactaacgacgtatagacatagtataaaaactatgccttaattttgttgtagtattatatgtataaatgcaggtcaatgctcatgttgagaattgacctgcatttttttgcgcaaaaggagaaatattatgcttgaaaaatattggataaaatgtccaatttgtaacggaaagacgagggttcaagtattttataatacggtattaagaaattttcctcttttctgccctaaatgtaaattaacgcatatcgttgatgttgaaaaactagaaatcataatcaaaaactctgaaaaacaaactttttaattttgaaaaggaaggatatttaaatgaaacacttacctaaaagtacacctacggaaatattgaatgacccatacggatttacttacaaagaaatgtcggaagtaattggagaggataaagcaagagccttatatacggaattgtataaacagccatttcacaaagaaaatctatcaatatcaacaaaaaaagtctataaaagtagcgatactgaaaagtatgtttatgaattgaaagataacaggtatattgaaacggtttttattaaacggcgagatggtgggactgtttgcgtaagtacgcaagttggttgttctgttggctgtattttttgtgagtccggacgcaatggttttgttcgtaatctaacaccgtctgaaattgtgcagcaggttgtattgatacgtcaaaaagtaaatcgtatcgtttttatgggaatgggagaacctttattcaattacgacaacttgattgcagcaatccatattcttcgagatagaaatggacttaactttccaaccgacggcattaccgtatcaacagttggtccagttaatcaattaaaaaaattgcgcgaagaacatctaaaaattcagttgacaatatctttacatgcagcaacacaggctgcgagaaactgtatcattcctcatatgcacatgtacgctattgaagatgttgttaagcaagcattgtcctattctcaaaggcataatcgaaaagtggtatttgcgtatttgcttttaccaggtataaatgaccgttcctcagatataaggcaacttgcaaaatggtttaagggcaaaaatgttatgattaacgtgctgcaatacaacccgacgagtaattcaaaaattagagcaccacaaaaacaagaaatggttgcgttcaaacatcaattagagcaaacaggacttgaagttaccatgagagtttctcatggtagagagattaaagcagcttgtggacagttagctaatacatataataaagccaaaaaacaacagaaataatttaattaaaagagccagacgcacagacgcagagccgataatatgcagtttgaaatactgctgttatcggctcttttttgattttaatttgtgcccctaataaccatattggagcaaaatcagaactgttgcttgtcgttctttgatttccgcagcagctttgaaaaatcaaagccgccgtttctttttatcttctaatgaaatgacgcggtatcactgttgaaatcggcggctaaaggaggtagccgccatgaagcaaaaagcatatcgacaaaatccgacagttattgacttatcaaaaaaagcccgcccaccaccgggggaaactacgcttatatatatgaactgtctaatcatctggatactgcttacaatgcctatgcgcccgtccgggcttttcggacgggcgcattttgtacgttcaaaaaatttttgaagaaatttcaaaaaatcttcggcgtttttgaaaaacgccgtattgccccgcgaaaaggggggaagcaccaccaactttccaacgagaaaggaggtgagaatgtggaacctaatagcagggagttttacaaacagtgtgcttttcagaagttttgtaatacggtattgcacaatgaagcttgcgacacccatagagaacttcgcagacacaaggcaaaggaagtgaccttttccgacatgaccttagacgaagcgcggcagcttcatacgtttgatgaatatttcaaacgtgaagccgccgaaaccgtctttgagaaagccgggaagaaaatcacgccaaagctgcttcttgaagcaatccgtactttgccggaagaaagcgcaaagccatattgctgtattacttcgagggaatgaacgataccgagattgcggagctgttcaacacgtcgagaagcacgatacagtacaggcggacaagctcttttgagaaattaagaaaatatctggaggaaaatgctgatgaatgggacgaatggtaacgaacccggctacccggaaaatgcccttgttccttatcctgtcattgtggcagcgacaaagggcgacccggacgccatgaagattgtcttgcagcatttcagcggctacatagcccgcctctccatgcggaagctgtacgacgagcgcgggaacgtctattttggcgtagaccacgacattcgggaacggctgcaagcaaaactgatgatggctgtcctcacctttaaggcagaggaataaaccgcagcggcggcgggacgctttctctctcccccttttccgttccgctgctgacgcggcagcaaagccattctgaaccttgacaaagaaagcggcgcaagataacggcggcgcagcatagggcaaatcggatacgttccttttgcgccgagccatacggcgggtgcgccatgacgctatccgggtgaggttatccccgcccggacagccgagcgaccaacaccgcgccggaaagcaagtgtagcggcttgcgggcgacgacacgcagaatatacaatgatacttccttacagccacagtccgagcgttaagagcgtcgcaggcaatgggtagggcggcatgagaaccatgccggggtgaaattcccatgaggttatgctaataaccgtccgattaaagcctttgttttattgaatagtggacttgctgctattcatagactatattatatgtttgcgaaagaaagggggattttctttgacgcaaaaccaaacgcccgttaccacaacggagcataaaataggaaaagttacttaccttgtatgttcgtccgcaagtgaacgcgcaacggacacactggataaaaagataaaaaaactcattcgcaaagacatggaactgaaccccgcaaacgcccggaaatagggcgtttcttcacattttatacatgacacaggcagcggtatgtggtataatatagacagtacaaataccatgcttgtctgtcgtcggaaaggaggacaaaatgttacagacagacaagattaccgctttatattgcagattgagccaggaagatatgcaagccggggaaagcgagagcatacagaaccaaaaactgattttacaaaagtatgctgacgaacaccactttttcaacacgcgctttttcgtagacgacggattttccggcgtgagctttgagcgtgaggggcttcaagccatgctgcatgaggttgaagccgggaacgtggcgaccgtcataacaaaagacctttcccgtctgggacgtaattatctgaaaaccggggagctgatagagattgtctttcccgaatatgaagtgcgctacattgccattaacgacggtgtagacacagcaagggaagataacgagtttacccctctgcggaactggttcaacgagttttacgcccgcgacacctcaaagaaaatccgggctgtcaaacaggcaaaggcgcagaaaggcgagcgcgtcaacggcgaagctccttacggctaccttatcgacccggataaccgcaatcatctgatacccgacccggaaacggcgcacgtcgtaaaacagatttttgcaatgtatgtacggggcgaccgtatgtgtgaaatccagaactggctgcgggacaatgaaatactgaccgtcggggaactgcgctaccgcaggacagggagcaaacgccacccccgcccacagctcaacgcatggtacaactggccggataagacgctgtacgacattctgacaaggaaagaatatttagggcataccataaccgggaaaacctacaaggtatcttataagtcgaaaaagacgaaaaagaacccggaggaaaaaaggtatttcttccccaacactcacgaacctttgattgatgaagaaacctttgaacttgcacagaagcggattgccacccggcaacgcccgacaaaggttgatgaaattgacctgttttccgggctgctcttttgcggggactgcggctacaaaatgtatgcagtacgcggagccgggacgcttgaacggaaacacgcctacacttgcggcaactaccgcaaccgggcaagaaatgatatgctctgcactacgcattatatccgcaaaagcgtattgaaagaacttgtccttgcagacttgcagcgagtaacgtcttatgtgaaagagcatgaacaggagtttatcgaaacagccaacgagtgcagcgcaaaggcagtacaaaagacgctgacacagcagcggaaagagcttgacaaggcgcagaaccgtattaacgagctgaacatcttattccgcaagctctacgaggacaacgctttagggaaactttcagatgaacaatttgcttttctgacttccggctatgatgaagaaaaaaagacgctgacccggaggattgcggagctgtcacaggaaatcgacaacgccaccgagcgcagcgcggacgtaaaaaggtttgtcgcactggtacgcagatacacagcgattgaagaactgacctacgaaaacgtccatgaatttattgaccgtattcttattcacgaactggataaggaaacgaacacccgcaaaatcgaaatcttttatagctttgtcggcagagttgatacaggtgacaagcctaccgaaagtatctcctatttcagacagataggagccgacgtaaagagttatgctatctaacatacatcaaaaagaggtaagataacaccctctgcaaaaaaggtatcgttatcttacctcaacaaagttcgtccccgaccagccatcgtccacatactcaccgactacatgaagtccctgttcctttgcgtactgttgcaggattgtccgctgtgtttcaatgcttacgctgtcaccatagttttcatcgtcccggcttaatctcatataaagcgccgtgttgtaaatcgtagtattgtaaggttgtttcaccgttaaaaatcctccttctaaagaaacaacccacgcttacaatacttttgctctatggcaattatatcataagcgtgggcgtgttatcaatgatgggtatcaggttgaagcggctttttctgcggtatgccgcaccacatctacaatcagatcaccgaggggcttcccgcctgcggcgaagtgttcggagatttttatacggttgttcccacatacaaaatactgcgtgccgttctctgcttgtatgacctgccctgtccggggtgtaaaaatatcgctttcgctttttgccatccagtgtcctccatattcagttttcaaggtacaatgccgcacaggagcggcgaaaatttctgcttatatctatcacctttcctttaccgtgtgccgctgctgccgtttcagttccgccagtatatccggcgggatacggtcaaccagccgctgtaaattgtccagttcgcttttcagctttgcccgttccatcgtatctttcatcttgcctttttcactggcttttgcccttgcttccagcttttcattttccgctaacaggtcattgattgtgaccttgtattttttcaactgcccggagaaattccccatctgtgggaaccactttttcagcatggagagggcttcctcttttttctttccggcattcagcgggttaatgccgtccagcgtggcttcaatggctcttgcctgtttggatagattgaccgcctgcttgaacagacgggtggggatatgcttcctgcctgtcttgctggcactttccccacgctccaagtcaggatatttctccaccatataggcgtgaaaatcgtcctgccattttgtgaggttggctctgttccctataatctcctttgcacacaggcggttgtcctctgtcagcgggacaaagaccaaatgcaggtggggtgttttctcgtccatgtgtaccactgccgacacgatattttctttccctacccgcccgattaagaaatcagccgccctctggaaaaacgcctgtatctcctttggggatttccccttgaaaaactccgggctggcggtaatcagcgtatcgacaaaccgtgtgctgtccttgcgggtccggcaccccgcctgttcaatccggctctgaatgaagtggtagtagcgtccctccggcttgacgatatggaagttgtatttgctccggctggtgtcaatgtcggggttgctggcgtattgctctttctgccgttcgtgatgggcttccagcggtcttgccgggttgcccttgtgcttctcaaaccgcaaaattgcgtgttgtgccattctgctcctttccccatccctttcctatccggggttttccacagggaaaatctcacaggaattagctcggataggattggaatggatagaatataaatcaatctttttatctttgtatttctatataccgtccggtttccgtactccaagagggttgattttcgtacttgtcaagtgcggttttcagtcctccggcgtaccagaacgggatttcttgaagtcggtgtttggaaccgcttcaaaggattttgggtagatgcggttgggttttccacagccctgcttctggatctccaccaatccggcatattgcagttctcgcagggtgttcaccgccttttgccgcccacagtggagcagggcgactacctcgcagattggatagtacaggtaaatgcgcccgtactcgtccgcccagccgttcttacgggacaactccgtccggcgtaggataaaggcgtacagaacctttgcctcgttggacaggggcttgaatgtgggggtttcaaagagaaaattcgggagccgggtgaagctgaacgccttttctggctgatggatatagatggtatttgtcatagtgcgttttgtggacggttagaagcccgttttccggggtgggcgatactttataccacccgccccggtttggggctcgcaaaacctgataaatcaaggcttttttcgctcctaactgtccacagcagacctccttttccgttcactttctgttttctgccgcctgtgaactctggcggcacagccggggcagtattttgcccggttggatttggggacgaacacgccgccgcagaccgcacagcgtttcaagtccttatcccggaaaatctccgcttccagcgttccgtccagcggcaaaaccgcccagcggaaccacttacagcagaccgagaaagaaaccgtctgcgggcaggtgcaggtgtccccatcgtcaagggcaatgcagttgccgtcctcacagcaacagcactcccggcgtatcaggctggccgcctgtttcctctgcgccggtgtcatgcggtaaagggaaccgtccggcctgcgttccagcggcggcaagtctttataggggttatctctcatgcgttccctccattttgctttccgttgccgttctccccgaaaaggtttcctgccccattcctgcggcgtattccggcgttggcacgctccccgcaacttcgggacattttgtcccgaagtccggctccttgcggtgcttccccagccggggtatcccttttcggacggtcattctgtttccaaggtgctgtccatcgatgaactaccctaagtctacacgaaaaaaatgcaatccccggaattttgcgagaattgcattttgatgaagtttacactttggaaattgcatttttgcaatcattctgtataatggaagtgtgtggaggaggtgcgtatctatggctttacccggaacacccggacagcggatttccgatttatgcaacgggaaccatatcacacaaaaggaacttgcagagaagataggcgtttccgcttcccagttgagccgcattgtcagcggcgagacgagaacggtcagcagtgatattctcataggagtggcaaaggaatttaaggtatcgacagactatatactgggcttgtccaccgtgagcgtccgtaaaagttacgatatttctgaattaggtttgtcagagggagccgtgagggggcttgtgacgggtgctgttgatgtgcaaatactcaatcgcttactggaacacaggaattttcccaagctgatagatttgatacggatttattttcaggacacggcggcaaaggggataatggcacgtaaccagcttatcgagatggcaacggcttccctgtccgacttgatgaaagaacacccggaacaccgggcggaagcaaagcaggatttacaatttttgaacgcccagaagatgggggaacatgaagcagagattgagaaaatcaaaaatgtgttccttgctatcctgcgggatattaagaaagacattgataacggagaacagccgggggaagctgtgaccgccgctatgttccaagccatgcgggacgcactgtcggagcagaagcaaaacccgctttccattgacgatgtaacagcaatgataaccggacagatcggacagcttgcgccgatggacgaagaaactgccgacctgttccagcagctggcgaagaaaatgatgacgcaaatgttaaaagatagtgatgagaaaaaaggagattgattttatgaaaaagatactttcatgctttttagtatgtgcttttttatgtacgggtttatatgggtgtggtagtaaaaaaacagagctgattgaagaagccaaagacctaacactttcccaagaaatttcgataacccccgaacaaaatgattatggaatacccgcatataattttttaaaacatattcaatcaaactatccggggcgcgttgctggcactgaaaaagaaacggaaatggctgtatttattttgtccgtcctcttaaatggtggatatgcggaaagcgacatagctatagagtcttttgaaatagatgattccacgcctatgatggatgaagccatacaaaatgtattcgatggaggtgaaaaaagtaattcaagtcaaaatattttgataaccaaaaaaggagaaagcgaaaaaacgattattgttggcgcacattatgatagtgctggaacacatggtgtagatgacaatggctccggcgtatctgttgctttggaaaatgccctgcgaatggtcaacactccaacatactatactattcaatatgtatttttcggttcagaagaaccgggaatgtatggctcaagggcatacgttgaatcactttccgaaaaggaaagagaaaatattatattgatgataaacattgatactgtcctcgctggggattacctttatttgtatggcggtaaggtgaatgataacggcactgttgataataccgaagcagtatttaaagcctacgaaattgttaaggaaattggcttgaacatacaattaccaccagacggaaataacgattatccctatcctacaggtcaaaaaagaagcgaccacgcaccgtttaatgacataggaattccgtacatatattttgaagcaaacaactgggaaaatggttctcctgtcgaaacagaaaagaatggattgataatgcatacagatatggatgatttggattttattgaaaatgaatatagcggacgtgtccaaaatacactcagcagctattcaatattattatattctttacttcaagaaaacaactgggagcaataacacaaatggatagcaaagacatccgagccagtcaacggtcaagatgaacggcgcatttcatgcaccgccgttgacagtcccgtctgtctttgctgataggcaatcaaggcgggaaagccctaaaatggcttcccgcccatttcaatttttagagaaaaacgctccaaaatcagaaagagagcggccaagcactttgcgggattggccgccttgtccacccattcagcgggacggcgggtggcggtcaaggccgggtgtaaatccgttcatttcagccttgacggttgcccgttgtcttgctgattttccgggagtgtggccacaacttcgggacattttgtccacaagtcggagcgtaggacgagggacgggggctttcatatacgccctgtctgctgatgaaaacagacctgcgcttgcggctccacgccacacaagcacagccctgttttcctgccgcttcaaatgcccttgccctccccggcggcaacggcattttcacggcaacgccgacagagcgtataacacactacactttgcttcgcaaagttgtgtgccaaatgggggcgttgccccctttggaaacccccacaagaaaaggcggtacgctacccctccacggggcgcataccgccttttcttgttatccagccctccggctgtatcggttgagcaaaagtcagcgtgggaatggtgtggtatctttatctaagtgaacccccgctgggccgccaggattttgtgtaaaatgggaaaaagcctagcgccccgccgcattctctgctataataaggaaaaacgcctgaatcccacaaggcacaaaaaacagagaggtgaataacgatggatgaattgacaaacaccgcggccctgtccgacgacgcgcgtgcaaacaggctgtccgggctgataaacaaaaatcgccgcatgatcgcgtcggctttcggcgccgccgttttcgtcgccgtggtcaatacgctgatcggcgcagccgcggctttggctcccggtattctggacagcctggaattcagcggcttcggctggtttttctgcctgtttggctttatcatgtttgctgtcgctgccggcatccattataaaagccgcgtctgtgtcgtcatcggacttgtattcatggttgcggacaccgccctttccgatctgccagctctgcttcgggaaggcaatatcttttatttcattatgcgcggcttcatcctctactcgctgattatggggcttatcggcgcgtttcaataccattcctataagcggcgtttttccagcgatcccaacccgacggttgccgcgctgttttccaaaaaccgttttcacctttcagcaggaaccgttatcttttcgctgcttatatcagcttctctggtccttggggtttacaacttttttatggagggccggtcagatttcgatatttcatcatgggatacctataccactgcggacggcctggtgaccataccgatgccgggcgcgcccgaagtcagtacggccaacggaatacagagtatgcgcagcctgtcgcgcaaagcatttgtcagtgttgaccgtgtcgccagcagcggcctcttttccggcctgagcgccgatgagaaggaggcggcccttacacagatgcttgaatcagggctgaccgggcagcagctttcctataagctggacgccgacggccccgacggcgcacaggcgtgcgtcattgcggactcctatcatgatggcgccctcgcgcgttacgaggcgttcttggtggacgacaccctttatatcgccatgctcgctgcggacgccggccgggacgacgatcaggcgctcgcgctgcttgatcatttttccggtgcgattacgatcaaccgctgacaaaaagccggccctgcgggccggcttttttcctgctttttctattcgataacctgtgtcgcgtcatcaagatcaagcatctcatccccggacgcggcctgtcctcccgcctgcggcgcggaggaaaccgcctgctcattcacggcctgctcatcgtcaacggacggcgtcccgaccgatacatcgggataagcctgcgcgaacatccgctccaattcctcgaacatgcgcgcgctctggcgttccagcgcaaccgcatcaaccgggtacagccgcccgttttgataagcgtccgtcgtgctgtaaacctgcgtaccggcaaaatacgccgaatcgatggacgaatcgtaaaagatcacatctggataaaggttgacagcctcgccggccggataatcccagcctgtgaattcggccgcgtcgttatcgacgccgatcgcctccaaaagctgtccttcaaaggtatcccctgtcgcgatcagcaggggggccgcgcgcagatagacgccggatacacgatctgttatcccgccggcggcgtctgtaagcgcgtcatagcgggcgcgcagcgcgccaaacacgcgccggccgttttcgccgccgtcctgcatcccgtcaaggaccgtcgcggctgtgacatacgttgtttcaagcgcatcgatcgaaccggcgcgcggcagcacaaccacctccgcgcccatctgttggagcgcgactgtatttgcctgcgtcatcggcgcggacacgaacaccacgtccggcgacagctcgcgcagacggtcgagatcgggcgactgcgctgtgccgcagtccggcagatccccgatgtccgcgggaaagtcgcaataggcgctcacaccggccattcggtccccgccgccaagctcatagagcacctcggtcaacgcgggcgaaagagaaacgatccgctccggcttttccgccacacggatatctccgatcgcaaccggccagttcgggtccggctcctcctgccgtgcctgcgacggggatgaggacgcttccccacgctccccgccgccaaagcacgctgccagcgtgcaggcaagcagcgcggcaagcagcagcgccgtacagcgcaaatgattcatatcggcacctctctggataaagggttattttcaagcgttttttaagcgtttccgtacctcattttatcctatcagagtatcgctgtcaaatgcgcgccgctccagccggaaagacaaggcgtgcccgagcgccccgctgttcgcggcgcagcctgtataaataccggaacccgccccactattcgcggcacagccgattaaagtttttcgccgaggccttttttcaaaaaggccggaaagtttttcgccgagctttttttcaaaaaagcgggggcttctccatgagcttgaccatgacggccttctgggcgtgcaggcggttctcggcctcgtcaaaaatttcattggcgtgcgcctcgaaaacggactccgtaatctcctcgccgcggtgcgcaggcaggcagtgctgcaccataacatccctggcgcatacggaaagaagctcgtcgttgacctgatagccagtgaaggccgcgcggcgctgctgcgcctcgccctccatgcccatcgacgcccagacgtccgtaaaaacaacgtcggcgccggccgccgccgcatggatgtcgtcggtcaggctgaatttatcgccataagccgacgcgaacgagagcaccgttccatccggctggtacgccttcggcgtagcgaccgacacgttcatgcctacctttaaaccgccgacgatcagggaattggccatattgttgccgtcgccgatgtagcagagcttcagccccgccaaaccgcctttatgctcgcgtaccgtcatcaggtcggcgagcacctggcagggatggcagaaatcggtcaggccgttgatgaccggaatggaaccgaattttgcgagatcctcgacctcctgctgcgcgaatgtgcggatcatgacgccgtcaagatagcgcgaaagtacgcgcgccgtatcctgcaccggttcgccgcggccgatctggaggtcgttggccgaaagaaacagccccgtgccgccgagctggtggatgcccacctcaaacgatacgcgcgtgcgcgtggagcttttctggaagatcataccgagcgtctggccctttaacctctggtggtcgatgccatgtttctgctcatatttgagctgatcgcccagattgagcagttccgtaatctgttcgccggaaaggtcgagcagctttaacaaatgcttcattgtgacaacacctctcttaaactctgtagcccttcgtcgatttccgcatatgtaatcgtcagcggcggcagcatccgcagcttttcctttgcggtcaaaataatcagcccatgctccaggcaggccgccgcggccgttttgctgtccatgccgccgagcgtgacgccgagcatcagccccttgccgtcgacacgtttgacgcacggcatcgcaagcacccgctctgtgatataagcgcccttttcttcgacttcgcaaagcaacgcgccgtccaggcggcgcagcacctcgcaggcgccggcgcacgcgacgggattgccgccgaaggtcgagccgtgcacgcccggcccgagcgtatccgcacatttttcaccgagcagcaccgcgccgatcggcagcccgccgccaagccccttggcgagggaaacgagatccggcgtcacgccgtaatgctcgcagcagagcagcctgcctgtgcgcccgacgccggtctgcacttcgtcggccatgagcaaaacgtcgttttcacggcagagcgccgcggccgcgtcgacaaacgccttgtcaagcggtacgactcctccctcgccctggatcagctcgagcagcacgccacagacgccgcccgcctttacagccgcgcgcaacgcgtcgatatcgcccgccgggacgaactgaaagccctcggtaaaggggtcgaaatactgatggaaaacgtcctgccccgtggccgacagcgttgtaatcgtgcgcccatggaacgaattgacaagcgaaacaatcatgtgcctgcccttgccgtagcggtcaaagctgtatttgcgcgcagccttgatcatgccctcattcgcctccgcgccggagttggcaaagaataccttttttgcaaacgtgcgcttgcacagcagctcggccagatcgaccatgggcccggtatagtagaggtttgaaagatgctggagctttgccgcctggcggctgacggccgcaacccatccggggtcgcagaagccgagcgaattgacgccgatgccgcttgaaaaatcgatataccgccgtccgtccgcgccggtgcagacggcgcccgcgccgcaggccgcctccaggggcgaccgcgcgtatgtcggcgcgatatattgttgatcacgttgtgcaacgcccattttcaaaaccgcctttccgccgccgcagcggcaagcccgggcatcatccgacgaacatggtgccgatgccctcgtttgtcatcagttctatgagcagggagtgcgggatgcgcccgtctatgataaacgcgcggcgcacgccgcggcgcaccgcctcgacacagcactccacctttggaatcatgccgccctggatgatcccctggcgcacgagctgcggcacgtcgctgacgcgcacctcggggatcaacgtgccctcgtccgtgcggtcgcgcagcaggccgcgcacatccgtcatggaaacgaggttctccgcgccgagctccgccgcgatgcgcgcggccgccacgtcggcgttgatgttgtagaccgtgccgtcgccgccacaaccgagcgtggcgatcaccgggatataaccgcggtcgagcgtgtcgaggatcggctttgtatcgacgcttgtcacctcgccgacaaaccctatgtcctcgccgtcctttgtcacgcgctgcgcatggatcatgccgccgtcgatgccgcacagccccagcgcgtggcccccctgccgctccagcaggttgacaaggtccttgttcgtctttccggccagcaccatctgcacgatgcgcagcgtttcggcgtccgtgtagcgcagcccgccgacaaaccggctctctttgccgacggcgcgcagcgcctcgttgatctcaggcccgccgccgtgcaccagcacaatgcggatgccgacgagcgacagcaaaaccagatcgctcatgacggccgccttgagctggccgtcgatcatggcgtttccgccatatttgacgacgaccaccttgccgctgtacgcctggatatacggcagagcctgcgcgaggacctgcgccttctcctgatttgcaatctgcacttgaatccctcccccgccgtcaggtgcggtaatcgccgttgattttcacataatcgtatgtgagatcgcagccccatgccgtggcggtttcgccgccctgggccatgtcgatctcgatacggatttcaggctgcgccaggattttggcggcctgctcctcggaaaacggcacgcccgcgccgttcgaacagacgggcacgctgccggcggcggacgaaagcgtcacgcccacccggctgacatcaaactccgcgtccgtatagccgatggcgcacagcacgcgcccccagttggcgtcgccgccgaacatcgccgccttaaaaaggctcgagcagatcaccgactttgcgacctttttggccgtctggcagtcgggcgcgccagtcacggcgcattcgagcagcttggtcgcgccctcgccgtcggccgccagctcgcgcgccaggcgccggcagacgatcatcagcccctgctggaagtgatagtattccttgccgagggatttgatcggctcgttagcggccgcgccgctggccaggatggcaagcatatcgtttgtcgaggtatcgccgtcgaccgagatcatattgaacgtctcgtcggccacgtccttgcacgccttctgcaaaagctccggcgcgatgtccgcgtcggtcgtgacaaagcagagcatcgtcgccatattgggatggatcatgccggagccttttgcgatgccgccgatcgtgcatagcttatcgccgatcgggaagcgcacggcgacctgcttgcgcttcgtgtctgtcgtcatgatcgcctcagcggcgtctccactgccgccggtggaaagcgacgccgccagcgccggcatggcgtccttgatcgggccgagcggcagcggctggccgatcacgcccgtcgaagcgaccaccacgtcgttcgccgcgattttcagcgcctgtgcggcgcttttgcacatcgcggcggcaatatcgaggccgtcagcgttgcatgtgttcgcattgccggaattgcacaaaatcgcgcgcgcccggccgttttgcagatgctcgcgcgtcacgatgagcggcgcgcccttgaccttgttctgtgtgtaaatggccgccgcgctgcacatccggtcggcaaagatcagcgcaaggtcctttttatcgtggtttttccggatacccgcgtggaccgcgcccgccgaaaacccctgtgcggcgcagacgccgccctccacaaatgtaaaagccatagacggttctccttctattaaaatgcgggcggtgcgagcacgagacccgcgccctccggcaacccacacgcgatattcatgttctggatcgcctggccggccgcgcccttgaccatgttgtcgatggctgatacgacaatcaggcggccggtacgcgtgtcggcgtgcagcgagatgtgacagagattggagtatttgatatttttgatgttcgcgaccgcgccgtcgggcagcacgcgcacaaacgcctcgttacggtaaaaatcctcatagagcgcgcgcacgcgcgccaggtcaaagccgggcgcgagcgaagaataaatcgtcgagacaatgccgcggttcgccggcagcagatgcggcacgaatgtcactgtcaggggcacgcccgctacgccgccgagcacctgctcgatctcgggcgtgtggcggtgcgccgcgaccttgtacggcgcgaacgcctcgttgcattcggcgtaatgcgtattcagcgccagcgaacgtcccgcgcccgtcgcgcccgatttggcgtcgatcacgatcgttttgggatcgaccgcgccggagcttacggccggcgccagccccaggcacgccgacgtcacataacagccgggattcgcaatcagtttcgcgccgcgcgcacgcgtgcggtgcagctccgggatgcagtagacagcctgctcgtgcagcgccgggtcggcgtactgcccgccgtaccaccggcggtaatcggcttcgttttccaaacggaaatcggccccaaggtcgatcatcagctttcccgcgtcaaaacaccgccgggccagtggttccgcgtggccggccggcatggatgtaaacacaacgtcgcacgcgtcgatcacgccgccgtcgtccgtcagcgtcagatcgcacagccccgtaagctgcggatagacatcgctgaccgcctgcccggcgtagctgaccgaggagacggccgtcacttcggcgtgcggatgcgccagcagcagccgcacaagctcaagcccggcgtagccggtcgcgccgatcacgcccgctttgattgttttcatccttacccctccaaaccgccggccgcggcttcacgctgcaaaaatgcccgcgccgacgcaatctgcgctttcaccgcctgcggcgacggcccgccggcgctcgtgcggccgcacacacatgtttccagcgcgatcgcctcataaatatccgaatcaaacgccgcgctggccgccctgtaatcgtcgagcggcagtgtctccagcgtcagcccgcgcgcaatacactgcgccacaagcccgcccgtgatcttgtacgcgtcgcgaaacggcacgccctttttcgtcagataatcggcgcagtcggtcgcgttgataaagccgcgcgcggcggccgcgcgcatattgtcctttaaaaccgtcatcgtgcgcagcatcggcgtaaaggtcacaaggcacagcttcacggtgtctaccgcgtcgaagatcgcttccttgtcctcctgcatatccttgttgtaagcgagcggcaggcccttcatcattgtgaggagcgtcaccaggtcgccgtaaacgcgcgccgtctttccgcgcaccagttcggccacgtcgggatttttcttctgcggcatgatcgacgatccggttgcaaacgcgtcgtcaagctcgatgaacttaaattcccacgaacaccacgcgatgatctcctctgagaagcgcgacaggtgcatcatcaccgtggaaaacgcggcggcgagctcgatgcagaaatcgcggtcggacacgccgtcgagcgaattttccaccggcccggcaaagccgagcgccccggccgtcatcacgcggtcgatcgggtaggtcgtgccggccagcgcgcccgaaccaagcgggcagacgttcatgcgtgccgacgcgtcggcaatgcgccccacgtcgcgcataaacatcgaagcgtacgccatcagatggtgcgccagcgtgaccggctgcgcgcgctgcaagtgcgtatagccgggcatcaccgtctccaggtgcccgccggccaggtcgcacagcgttttcagcagctccagaagcagcgcgcgcacggccgccgcctcgtcgcgcagataaagccgcacgtccagcgcaacctgatcgttgcgcgagcgcgccgtatgcaggcgcttgccagcgtcgccgatgcgctttgtcaattcctgctcaataaacatgtggatatcctcggcctgcgggtcaaacagcagcgcgccgctttgcagatcgccgcaaatgctgtcaagaccatcgcagatcgcgtcggcgtcggcgcgcgggataatcccctgcgcgccgagcatctgcgcgtgcgccatcgaacccttgatatcgtgcgcatacatgcgcgaatcaaaccggatcgacgagttaaaatcgttgacccgctcgtccgcctccttggaaaagcgtcccgcccacagcttcatttggtttcctccatacaaccggccctccgcggacagcggacggcgaagataaaacggccgcggcgcggggtcccgtccccgtgccgcagccccgtttttcgttcacttaatcttcttttcatcgagcagcgccttgaccttgatcggcaggccgaacagattgataaagcccgcggaatcagcctggtcatagacatggtcctcgccgaaggtggcgatctcctccgaatacagcgaatgcggcgaagtcatgccggcattgatgatgttgcccttgtagagcttgagcttcacatcgcctgtgaccgtctcctgcgtcttgtcgacaaacgcgctcatcgcttcgcgcagcggcgtataccactggccgttgtagacgatctcgctgaacttgacggccatctgcattttataatgctgcgtctccttgtcgagcgtgatctcctcaagcgactggtgcgccgcgtaaaggattgtgccgccgggcgtttcgtacacgccgcggcttttcatgccgacaagccggttttcaaccatatcgacgatcccgatgccgtttttgccgcccaggtcgttgagctttttgacaatctccgccgcggtcatcttctggccgtccaccgcgaccggcacgcccttttcaaagctgactgtgacatacgtcggcgcgtcgggggccttctccggcgaaacgcccatctccagaatcttgtcgtaatccggctcgttggcggggtcctccagatcaagcccctcatgcgacagatgccaaaggtttttgtcctttgaataattcgtttcacggctgatcttcagcgggatatcgtgcgcctcggcataggcgatttccttttcgcggctgttcagctcccagaagcgccacggcgcgataatatccatattcggcgcaaacgccttgatggtcagttcaaaacgcacctggtcattgccctttccggtacagccgtgcgcgatcgcgtcggcgccctcctttttagcgatttcgacaaggcgctttgcaatgatcggccgggcgaacgaagtgcccagcaggtatttcccctcatagactgcgccggccttgagcgtggggacgataaactcgtcgacaaacgtctcggtcagatcctcgatataaatcttggaagcgccggtcttgaccgccttctcacgcaggccgtcaagctcgctgccctggccgacgtccgccgcgacggcgatcacctcgcagttataatgctccttgagccacgggatgatgacggatgtatccaagccgcccgaataggcaagcacaacttttttatacgttttctgctccacggtgattcctccaatatcggcgttatgtgatctgtactctattatacattatatttatgcaattgcaagcccaattttcgcataaatattcatgttaagagccatcgaattgggtattattgcacaaacaagctaagattgcagtaattacatcacttttccccgtcaaaaaaaatgagaaaatatgcatccatatacattggcctgccggttctttttcctgccggggtgtgctataatatagtcaacacgcctgaataacgcacgcggccggccggcgcgccggccccattgacgaaaggatgcgagattatgcaaaagatttccccctatgagctgcctctcaacgccttccaggccattggcaagcaatgggccatgatcacgacgcagcgcggcgatacggtcaacaccatgaccgccagttggggcggcgtcggaatcctgtggaacaagcccgtaacctatgttttcctgcgcccgcagcgtttcacacgcgagctgctcgacggcagcgagctgttttccgtatgctttctgcccgaagattaccgcgagcagctcgcttactgcggcgcgcactccggacgcgacggggataagctcgcagcctgcgggttttcggcgctgcatctcgacggtgcgcccgtgcttgcccagtcgcagacggcgcttacctgccgcaagctgttttgccagcagctcgatccggccggttttatcgatacgtccctcgacgccgccaattatccgcaaaaggactatcattttctgtatgtatccgagattctcggcgcctaccttttttaagtcatacgcccggcacgccggcctttctggagaaagcagaatttacataagcaatcgcggcagcgcacaacgggaggccggatatggaaaataaaaatttggctcggatcaagctgctcatcaatcgaatcgccgacctctatgatccgccgccggcggaacagacggaagaaatgcggatattgacaggcagaaattggagcgcggaagatctcaaaatggcgtgctttgaatattggagccaccattcgctggatgaaaccgcctacatgctgcttcacggcgattacccgcccgtctgtgaggaggagcttgttttctggagatataagcccggcgtccgcctcgacgacagcgcggtatatgaaaaataccgtttcggccggggcgcatcagacgcgctggagcctctgccgcttaaagaaatcatacagaatatacatgaatcgttccccggttgggaacaaaacacacgcgtcggcagcgacgggcgaagctggcgttttgattctctggaacaggccgcatactggacagatacgcacttttggatttttgaatacggacgggaaacgcagacgcaaagagagcatcaaatcctgtgtttttcctgccacaatatgacgcagacgcagattctcgctatcctgaagtgcatggagcgctttcaatgcgctctgcatatccgggaaagcgcaggcggggaataaacgtccgcagaaagccccctgccgcctggaacagcgccgtctccctttggctggccggatcggattttctcaatgcgtttaaaacagcgggtccgcaatcgcggacccgctgtttttatcagacgcgccattgggaaaccttgtgaagcaaacgcacgtcgaccagcgcgtcgacgcgcgtcccttccggctcatatgcctgcgcgtatactttgccggacgccatgatctcgctgataagccctgttttgtcatacggcagcatcagcgtgacgcgccggtgcgttggagcaagcagctccgaggtcttttgcaagagcgcgtcaaagccaaaaccggtccgcgctgagatcagcgccgtctgctgattaagcgcgcgcggcacatcggcgaccaggtcgcatttgttaagaatcacaagcatcgggatatcctgcgcgccaagctcccgcatcaattggcgcgttacctcgacctgttcggccatttcatcgctggccgcgtcgcatacgcaccacagaaggtcagcgcccgccgcctcctccagcgtcgactggaacgcctccacaagctgatgcggcagacggcggacaagtccgaccgtgtcgatcagcatgacggagcggccgtccggcagtgtgagcgcgcgcgaggtcgggtcaagcgtggcgaacagcttatcctcagacaacacacccgcgccggtcagcgcgttgagcagcgtgctcttgccgacgttcgtataaccgacgatcgccaccgtcgtcacgccctcctttttgcgccgcgcccgcagcaggccgcggcgctttttcagctccgcgagctgctcctgcaaagccgcaatccgccgcctgatatgccgccggtccgtttcaagctgtgtctcgcccggcccgcgcgtgccgatgccgccgcccaggcgcgaaagcgccttccccatgccgccaagccgcggcagccggtatcttagctgcgccagctcgacctgaagctttccctcggccgtcacggcgcgctgcgcaaaaatatcgaggatcagggccgtgcggtcgatgacagccacgccacacgcattttcaatgttgcgaagctgggctggggacagctcgcagtcaaagatcaccagatccgccccgtcgttttcacacaactgcgccaactcctccagccgcccgctgccaatcacggttgccggatcgcaggagggacgcttttgaaccagcttcgcggcagtttgcgcgccggctgtctgtgcgagggcctccagctcgtccagcgacgcctgtatgtcatattcgcctgtatcgacggcggccagcacggcgcgctgaatcgtttgcttttgattatcgaacatagcctctcctttgcccgggcgggcttttaccaaattctttgcattgcacttctcgcgcagatgggatacactcataatagaaattcatgaattggatgtgaacaaccgatgaagcttcttctcgcggccagcgcgcctctgcggccctatctcgaacggatgctccccgcctccccgcaccggatcgatccggtttatctgcctgcggcgcctgacaatcagaccctgggcggtctgattgccgacgcggcggattatgacgcgctgctgctcgcagacggcgaggtctggctgccggaggacggcgcgcccatcgcctcctgcgcgcgcccgattattttgccccgtgtacatagcgccgcttccctgctgctcggacccgcccgctaccgccgcctgttccgccggtttgacggcggcgtctgctggcgccttccgctttgtaccgagccgctgttcgacagcgcgcgcggcgactgcatgtgcctttgctatttggcggacacttcgctcggcctgccggatgaaagccttgccgcgcgtgcagccgcgcaggaaaacgggtgggattttttcgaggaggaaagcgatttgtccctgctcgcgcgccttcttgcgggcgcatgggattcggacgcatttgactcgtttggcgccgcgcatgaccgcgcataatgcaaagccattcaaacaagcaagcagggcgggtttaaaacccgccctgcttttgctatgcggcgcggcttatttgtcggtcacaaactccttaaatgatgtggccagccccgcaagcgactgaatctcgcttggaatgataatcttggtggctttcccatcagcagccttggagaacgcctccaggcccttgatcctgatgacgctgtcgctcggattcgcatcgtttaacagccgcagcgactctgcaaacgccgtctgaaccatcctgatcgcttccgcctcgccctgcgcttcccggattttctgctcgcggacgccttccgcgcgcaggatcgccgattccttttcagcctcggcgcgcaaaatagcagattctttttcaccctcggccaccagaatctggctgtgcttttcaccctcggcccgcagaatcgcttcccggcgttcgcgttccgccttcatctgcttttccatcgcgtcctggatttcacgcggcggcagaatattctttaattcgacgcgattgaccttgatgccccatttatctgtcgcttcgtcgagcgtggcggtgatctttgtgttgatggtgtcgcgcgaggtcagcgtgctgtcaagctccatctcgccgatgatgttgcgcagcgtcgtcgcggtcaggttttcaattgctgacatcgggcgctccacgccgtaggtaaacaatttggcgtccgtcacctgatagaacacgaccgtatcgatctgcatggtgacgttatccttcgtaatcacaggctgcggcgcgaaatcgaccacctgttccttgagagaaacctttttggcgatgcggtcgataaacggcgtcttgatatggaatccggtttcccacgtcccggcatacgtccccagccgctcgacgacatagacagaagcctgcggaacaattttaatgttgctgatcacaacgatcaggatgatcaacaacaggattcccaaaacaattgccataatataatcctccccaatatctggttattcacagcgttcaacgatcagcttcacgccgtcgatcgcaagcacacgcacccttgtattttccgcgatggcgtctgcgtttgatgagcgtgcgctccaatccagaccgttcaccttgacgcggcctgtggccaggtcattgtcgatcgcctggagcaccacgcccacctgtccgataacgctgtcagcgttggtgctctgctttttgacaaacagcagctttttggcgagcggacgtgtcgctaccagcagcacgccggccacaattacgaaaattaaaagctgcgtcggccaggggatgtcgatcaaggctgttacaagggccgttacggccgcgccgatcgcgaaccaaatggaaacaagctgaaccgtcaggccctccgcgaccgcgaaggcaatcccaagcgcgagccagatgatcggtacatagttcagttccatgccggcaatcctcccttcctgattgatggccggttcccgcgggatccgttgtgtgtacgctgcaataagcgcaaagcggttattgcagcagcatttgggccgggcgatacgcgggcgcggcccgcatacagcttcgctgtttgccctgcatatattgtaccacatttcaagcttatttcacaatatgcgaatgaattcctattgcgaaatttccgcccgcgcggacttttcggagcgcgtcaatgcgcccaatctcatccaaccgggcgcgcacgcggccgattgcgtcatatgtctggctggccgctcctgccgcagcgctcccccgcatgccatgcgctctttctttcaaaaaacccccgcgtgaagcgacatgctttacgcggggggctttcatacatgttgttttaacgatagatggtcacacggattacatcctcgactgcgcgcagcttggcggccagctcgtcggtgggagcgcccttgagatcgatcatcgtgtatgcgtagttctgacgcgatttattggtgaggttctcgatattcataccagcatcggaaatcagcacggaaattttagtcagcatcgcgggaatattgcgatggatcagcgcaacgcggaaatcaccgctgcgcggcattgaaacggacggcatattgaccgaatttttgatattgccgttctccagatagtcaaccagctcctccgccgccatacgggcgcagttatcctcgctttccggtgtagacgcgcccagatgcggaatcgccataacgcccggatggccgagcagttcgtcgcttgggaaatctgtgaaatagcagcggatctgtttttcctccagtccggcgagcaaatcctcgttgacaatcaaatcaccgcgcgcaaagttgagcaggcgcacgccgtggcgcatcatctggatagactgtgaattgatcatgccctttgtttccggcgtggaggggatatgcagcgtgataaaatcacagttttcatagatctccttaaggctggatgcacgccggatgctgcgcgaaacattccaggctgtctcaaccgacatatatggatcgtatccccagacctccatgtcgagatggcgggcaaaatttgctatacgcgcgccgatcgcacccaggccgatcacgccaagcgattttccggccagctccggaccgacaaactgcgactttcccttttcaaccagtttgggcacctcgtccctctgccctttaagtgtctgtacccattccatcgcggggaacaccctgcgcgcggacatcaaaagcgcacagattacaagctccttgaccgcattggcgttggcgccgggcgtgttaaatacaacgatcccctgctcgctgcatcggtccacagggatattgttgacgcctgcgcctgcgcgcgcaatggcggcaagctcggagccaagctccatatcgtgcatggcggccgaccggaccaaaatgccgttgggcgcctcgacatggtcgccgcagatatatttgctgcggtcaaacacatccattccataggggctgatcttattgagcgttttaatatgatacatatcaggcgttctccttttcaaagcgcgccatcagcgcaaccagtttttcgacgccttcaaccggcatcgcattgtaaatggaggcgcgcataccacccacggaacgatggcctttgaggttgataaatccggctttttttgcttcggcgacaaattgggcgtcaagctcgtcgctgcctgtcacaaatgggatgttcatcagcgagcggtcctcggggacgaccgtacctttaaatagctttgagctgtcaaggaactcataaaggagcttcgcctttttctcattgaccgcctgcatggcttccaggccgccgatttcatccctgatccattcaagtaccaagccgcagatataaatcgcatatgtcggcggcgtgttatacatggaaccattctcggcatgcgtcgcataattaaacatggtcggcgtcgattcgcgcgcacggccgatcaggtcctcgcgtatgattacaaccgtcaggccggcgggtcccatgtttttctgcgcgcccgcatagagcaagccgaaccgcccgacatcaatcggctgtgacagcacgcacgacgaaatatctgcgaccagcggcacgtttcctgtattgggcagttcatgccagacggtcccatagatcgtgttattcaggcagatatgaaaataatcggcgtccggcgtaaaagaagcaggatccagctttgggatataggagaaggtccggtccttcgaggaggcgaccgccttacaggagccatagcgcgacgcctcctgatacgcctttgtcgcccactgcccggtcaggacaaaatcggccttcccagaaccgtttaacaggttgagcgggatcatcgcaaactgactcgacgcgccgccctgcaaaaacagcaccttgtaattgtccggaatcttcatgacttcgcgcagcagcgcctcgcaatggtcaatgatcgcctggtactccctggaacgatggctcatctccataaccgattcgcccgtcccctgatagtcgagcatttcagccgccgcgcgtttgagcaccgcctccggcaacatcgagggtcccgccgagaaattgtaaacccttcccaaagtaattacctccctgtgttcaatttggcccaacatccattttatgtggaccatacccgaaaaaaatcattaccgtcattatatttcgattttgcggattcgtcaatcccgccgggtgcgacgtaacgattcccctccagacgttccggcgtgcatggcgcgcgtgacccgtgcgcgggtcacagcggcggcgtccactccggcgtccgccgccttcgcatggctttccgaagcgcggcagtcgccgcacttcgggcgcagacaagctgcggcagcgccacgcggcgcgcctcatgggacaggggcaggacgcccctatcccatggacccaaccccagggcaggcgcagcttgacgattttaccacagaacgcaccggcgagcgtcggatacgcttacaccaaacagaggtggggataacacaaggaggagggtcgttcgaccctcctccttgtgaggcgcgaaacggggcgcggccgcgatttatgcgcgcccggcgctattgcgccggaaagccccgcatagccagcgccgccaggcaaacacagcgtccggcggtgagcggcccgcgcgggccgctccttagcgcatggattatacgcgcctgatctgtcccttatccatcacaattgtctcgtcgcacaggcccgcagcctcgtcggcgtccgaagtcagccataacacggccgcgccgctttgcagcagcttgttcacctcaaaataaaggcgcatccgcgccgggatatcgacgccggcagtcgcgtcacaaagaatataaacgataccgcggcggcgtatggcgcgttcgaccagttcccggcgctgattaccgccagtgatatattctccgcgttcgcgcataccgatataagcgccgaaggtgcggcccagccgtttggtaaacgtatcccaaccgacgcttgcacgcacacccaatccgtcgcgccggccaccctgcgaagcctgatcgtaggaacggatcagagcttcgtcctgtgcgtcgagcgcaagcacgacgcccgcgttcattgccgcgaccggcgaacgcgtctccagcgccttgccgccgacatacaatgctccggtatattcatacagccccgccaaagcgcgcgcaagctcctccttaccgcagcccgcagcgcccatcagcgcggtgatctgcccgcgccgcagcgtcagcgagacgtcctcaaagcccggcccgcacagatgctcggcacgcagcgcctcgtcccccaattcaaccggttcccgcttatatagatctttggctttgacgccataaaccgcttcaatcaatgcggccttatcaaatgaactggtcggagccgcacgcacaagcgcgccgtcctccatcacacataccgtatccgctgtggcgagcacctcgtccaggtcgtgagagataatcaaaaacgatttgccgcgcgctttcagcccattgaccgcacgatacaaacattgtttttcctcagcgttcaggcgtgtcgacggctcatccaacaaaaagacctttgcattctcagagacgcacgcacgcgcgatttggatcaactggcgctgcgccggactaagcgcagacgccggcgcgcgcggatcgagcgacaaccccatatctcggaacaattcctgcgtggcggcgatcatacgcctgttgctgatcaccggcaggcccggcgcgcgcagctcctgcccaaaaaagatattttcatagaccgacagattcgtaaatatctgctgattctgcgccgtcaggatcaaaccattgtctgtggcctccgtcgtattgcggatcactgcgcggcgcccgtctatgtaaatctccccgctgtccgcctcaaatacgcccataatcaccgaaaacagcgtgctcttacccgaggcgttgcgccccacgatggcgcctacctccccctcgcgcagcgtcagatcaatgtcatgcagataaaattcactgttgatccggcggcataatccgcgcagctccagtatggtacgtttttccatcgattccaccaccccttggctgtcccgctatcggcttgcagcttccaaagcagccacagcctttgccacgtcaaggcccttgtcctcgtcgaatttcccgcgtccaagatatgcgccgagtttcgaaagcttgatggcgccgtctgtcttgagaaaactttccgtctttttgccgccgaccgtcatgacggcgacgctgtcgacattcaccctgtatcccgcctcacgcagcaaagtgatgacacggccggaacactgctgcgcatggattcgcggattatcgacggcataccgtttgcctttgtcgttgataatccactgcttgtcgtcggcgccgccgtaatattcgccgctatagcacagatcatatacaagcagcacgccgaaatagcctaccagcacatgatcggcccaaccggacagcccgcctgaaacaagccgcacattatccagcacgcgaaagccgcgcggcgcggcaaatgtgcgcagccgtttggatactttgcgcttttcattttctatcgtatcgggatgcatctttttataaataaaaagcacgatgccgataatgaacaccgcagcgcaaagcgccagaaaaattatttgtcctgtttgcataatatgtctccccctgtatcgcgtatcgcgcgcaaaacccacccgcggacgattctatccgtccgctgacgcggccgatatgatgaagctattgtatcatagattgccccgatttggcaaccgcacggcttttaaaaggcggcgcttgacgaatcgcgccgatgcggtatactattaacagccagtttaaacgcgcctgcaaaggaaggccgaaggcgcggccccctgcggctgcctgccacagcggccgaaggcgctttcatttttatttatgccgcgccgtgcggcggaatgggggaaatttatgattcaatatatacggcgtcttgcgctttgctgcgcgctgctcgccagcctgagcctggccgcctgcggcggtaatcagcctgtcgccgacagcggcgtggccgttatgcagacagggcctgttgtcagcgaacctgacccggaggccgccattgaaaaaatttatgaaacggtcacgatcgacggcctttccgacgcctccgaggaggatttgacggacaagttctttatcgacacgtcgcttttggatgaattttatgtgcgctattcctcgggccggttcggcgtggctgatgtgtttattctcaagccgtcaagcccggacgacgcgcccaaggtgcgcgagatgctggaaagcgtcaagctttcaaggattaaggagtttgaaaactacgatgtctacgattcctatcagatcgcgcaggacgcccaaatatttgagcagggcggatacattatcatgctgacgctggctgacaccgagggcgcgcgctcgattatcgatcagtatattccgcgcacctgacaacagcgcgccgaaaggagcaaagccatgtccaaaacgaatccggccggccgtgtcgtcctctttgacgaggtgcgcggtctgtgcctgatcctgatggtcttttaccacggcatgctcgatctcgttacaagcggcgtcgatctgacctggtttttttcatcggttatgcagcggtttttacagccggctgtggccggtacgttcatctttatttccggcgcggtcagccgttattcgcgcagcaatctgcggcgaggactggcggcgctcgcctgtgcctttgccgtgacggccgtcaccttttttgtcatgcccgccacgcccgatctgtttggcattctgcatctgctgggcgtgtgtatgctgctgtttatttcgctgcggccgctgcttgaccggatccggcctgcgtctggaatttgtctgttcgcagtctgttttttagcaacgtacaatctcccctggcatgtcgttggtatgggtccgctgtccgcacggctgccggatgcgctgtattcaaatccgtacctgttctggctcggcctgcccgcgccgggatttgtgtccgccgattacttcccgcttttcccttgggcgtttatatttttcgcaggcgcgtctttcggcgttttggcaaagaaaaagcgcctgccggcgatgttttaccgcgggcattgcgccgcgctttcatggatcgggcgtcattccctgttgatttatctggcgcatcagccccttttgatcggcctgtttgccatcgtgctgcccctatttggctatcaggttgcattttaacggccctttcttatccggcgccatgtctgagcatttccaaatgcagacgctatgggtgtgcaaaacaggatggacgcagcgcgtctttgggacggcctgttttttataacctggatacacagccagaggacaccaaatgaaggccctgcaaaaaaggagctgaattatataatggtaattgaacggctggacggccgcttttcagtctgtaagctgccggatttttctttggtcgattggtcggacccgtttctctttcttgccaggacggataccgaatactccctcgtctgttcggctggccgggcgcctgcgaacgcttgcagctgtgagcatggatggcgcgcgctgcgcgtcgcggggacgcttgatttttcattgaccggcgtgctttccatgctcaccgcgctcctggctgccgcgcaaattcctgtttttgctgtatcaacctatgacacggattacatcctcacacgtgcagctgattttgaccgcgccatttgcacacttgccggcggcggctgtacaatcgtttaacaacagcatatagcgggccgcctttagacggcccgcgttccctgcggacaaaaagagggaccggatgtcctgacatccggtccgaatctgtttgaggtgtgttttgaggagggtagagttactcaagatatttgcggctaatcttgagtacgtttttattataccccaattgcaaatttgtttgttacggacttatgtctgaattataaaaaaaagtgacatcttctcttaacaaactataaatactggtaacatatgtttcaaaattatacgccgctttaccagcggcggcagcgatgataggaagaaatttgcattttattctgcactttgttataatattcacgtaatattttcaaaagcagcggcgtcccgctttggcgcgcgcaatctgtgcgcggattgcccaccgccggccgctgcgcttgcctgtccggctattcggggctttccggcgctatagcgccgggcgcggacaagccgcggcttcgccccttttcgcgcctcacaaggggcggcgtccctccccctgtgttatccccgcttctgttcggcgcggtcgtatcgggtgcacgccggtgcgttctgtggtaaaccgccaggccgcctctggcccatgaacccaacccagaggcaggtgcagcctgcatcaacgcagtgccaaacccactgttcgcggcgcagccgagtaaagtttttcgccgaagccttttttcaaaaaggctggagcgcagccgacgaaagtttttcgccgaggccttttttcaaaaaggctggagcgcagccgagtaaagtttttcgccgaggcctttttgaaaaaaggccggaaagttttttagcttacctttttttcaaaaaaggtataagtttttcgctgaggccttttctcaaaaaggccggaaagaaggatgggccatgccggagctgaacgccaaggaagccgcagtgctcgaggtcgtccgtgacgcaatcgatcatggacttgccccaagcgtacgggaaatatgtgcgcgccttggtatgaaatccacatcgaccgcacaccattatttaaagagccttgaggaaaaaggatatattgaacgtgaaggcagcctcaaccgggcgattcgcctgccatgcggcaatgtgacgcgcgtcccgctcgtgggtacagtgacagccggtcagccaatccttgcggttgaatcaattgaagcatatctgcccgtaccaatacgcggcgacgccaaggatttctttgcgctgcgtgtgcgaggttccagtatgatcaaagcggctatccttgacggcgatatcgttattgcacaatgtcgcgatactgctgaagacggcgatatcgtagtcgcgctgatcgacgacgaggccacagttaaacggttctttcgtgagaaaaaacggtaccgcctccagccggaaaacgacgctatggatccaatttatacagaccatgtgacgattctcggccaagtggtggcgctgatccgtgagttttgacaagatccagatcagacagccatagcccatacaaccatcatttgaaaggactgtatataaattgattaaagcaattttctttgatattgacggcacactcgtcagctttcagacgcatgccatccccgaaagcaccaaacgcgctttgtgcgcggtgcgggaacatggcgtgcgtctctttatcgcgacaggccgccaccgcctactcatagaggagggcaatatccttgagggctttccgtttgacggttacgtaacgctcaacggccaattctgctatacagcggccggcgaggttatccatgaagcgcgcatcgagcctgcggatgttgcgggtctgcttgcacgccttgaggaaaagccgagcgcctgcctcttgatcgagcgcgaccggatgtatgccaatttaatcgacgaacacgttcagcgggcctggtcggctgttaaattctctacaccgccgttgggcgatgtgaaacaagcgctgcacaacaatatttatcaaattaatcttttcctgccgcaagagcaggaggccttctatctggacgccatgccgcacagcaacgcgacgcgctggagtccttatttttcagacataggaccaagcggcggctccaaagcggttggaatcgaaaagcttgccgcgcatttttccattccaatgtcagatgttatggcgatcggcgatggagaaaatgacatcgatatgctgcgtgccgccggtattggcgtggccatgggcaatgccagcgacgcggttaaacgagcggctgattatgtaacgactgatgtggatcacggcggaattataaatgcttttaaacaatttttcccatttattttttagtaaaggtatgtcttacaacatttcgcggcaactcggagcttaaataaagaaaataaaaaaccttcactataaagtgaaggttttttgtgctggcgaagacctatcttcccaggcggtcacccgccaagtattgtcggcacaactgagcttaacttctgtgttcgggatgggaacaggtggaacctcagcgtaataaacaccagcgattggctccccaagttggactcgaaccaacgaccctgcggttaacagccgcatgctcctgcgcacaggtcgcgcgcgccaaagtcggccgggcgagcggagcgcccggcggcgggtgccccgctcgcagattgcgcgcccaagcgtcatgatcatgaaaacaggagctatacggatgtcctttttgtattccgacagcaacaaacggtaccacacatacagctatgcgatgcggcggcggtttggcggcaaggtgatgcgtgtcagcctgaacgcaggctttacctgcccgaatatcgacgggacaaaggggcggggcggctgtgtgttctgttcgccgtcgggcagcggagaatttggcggaaatcccgccgaatccatcgccgcgcagtttacacaggttgcggggcgtatgtctgaaaaatgggacacgcctttgcggatcgcatattttcaggcgcatacaaatacgtatgcgcctgttgcggttttgcggcggctttatgaacaggcgcttgcctgtccgggcgttgtgggcctggcgatcgcaacccggcctgattgtttgcccgatgatgtctgcgcgctgctggaggaattaagccggcgcacatatttgacggtggagcttgggctgcagagcatacatgatgaaaccggcaggcaaatcaaccgctgttatggctatgatacatttttatccggttacgagcggctgcacgcgcgaaacatcccggtcggcgtgcatatcatcaacggcctgcccggggaaacgcggcggatgatggttgaaaccgcgcgtacattggcgcgtcttgacctgcatcttgtcaaaatccacctgctgcatgtgctggagggtacacagcttgcaaagctgtggcgcgccggggcgtttgagctgatgacgcgggaggcgtatgtacagacggtctgcgaccagcttgaggagcttccggctgaatgtatcgtcggccgcctgaccggcgacggcgatccggatacgctgcttggtcctgaatggagccgtaaaaagctgtgtgtgctcaacgaggtcgacaaagaacttttgcgccgcaactcctggcagggccgccggcgcgcgtgccccccgcttttttgaaaaaaagcttggcaaaaaactttagtcggctgcgccgcgaacagtggggcaggctttagttttttttacaggttgcgccgcaaaccccggggcaggcgcagcttgacggtttatcacagaacgcaccggcgtgcgcccgatacgatcgcgccgcccacaggtggggataacataaggggagggtcgccgaccctccccttgtgaggcgcgctgaggggcgctgccgcgatttattcgcgcccggcgggcggcaattgccgcctgccggaaagccccgaatagccggccgggcaagcggagcgcccggcggtgggcaatccgcgcacggattgcgcgcgcctgccgaagccttttttcaaaaaggctggagccgcggcgtcaatcgatattgataatctggcggcattttggaaaattcggacagccgaaaaactcgtttccctgattcgcgccttttttggctgtgcgccgcaccattgggacattgcatttcggacaaagcgggacggtaaaccgataatttgccggcggcgtaaacggcctttcctgatgcgccgaaacgaggatatcggcaatggcgcgcatatcctgctcgcttaacaggacgccggtatttgcttcctgcaattttttaagatggttgatcaactgatcgtgcttgataatcttatcccggatttccgccggggcattggcatcctggataacggttttggggttggccagcacaacgacggattgaaggagcgtatcccaatcctgtacgggcagggccggcatttgctcgctcaaaagccgtttgagcagatccacatggcgctgattttgcgtaacagggttatacatgccttcttttttgtaaaccaggccggttgctgttttaaaacaacggttgaaatcgcccttatttgtcacttcgatatcgtcgattagttttttgctttcgataaccaggataaacgatgtggcaatgacaacaaaatcaatttgtgctgttgtgtcctgatttttcaaataaaggtcctgcaaaatcaggataggcagatagctgtttttcagttcataggccacagttttttcaccgttcaggccgctggtcagctttttgatatcctttgctaaacggtctgcctgttctgggataatcagctccttccacttttccaatttttcaatttggtttttggtggaactgttttcttttataaaaatcggctctgagaagctcagaggctttacagccggctttgaccttaaaaaatccagaaacgccattatttgtcacccttttacgtcgatttatgcatttacattgattggacacattgccttttatacaaattatacgatggattgacacgtttcgcaatagcatatagtatcattatgcagcgttcgttcctgaaaagtggatggaagggaacagaaaataaaataatttcgctaaacaaaagtttagcgaaattgaggggaggtaatacaccgctgcaagaaggaaactatatgaaaatcccatgatgaatagaagcatgaatcgttaaacgaatagaagaacgaatcgtatttctattcgtaaattgggatattgtaccgctgcgaaaaatgcggtacaatgtaaaaaaagccgtcaaaggagggcgcttatgcagctgtcatttttgggggcggcgcatgaagtgacggggagctgtcactatctgcaagcctgtgggaaaaaaatactgatcgattgcggaatgcagcagggcccggatgaatatgaacaccaggagatgccgcttgcgccgggtgaggtcgattttgtgctgctgacgcatgcgcatattgaccattcgggacgtttgccgctgctcgcgaaaaacggatttcatggaacgatctgcgcgaccgatgcaacatgcgacctctgtgggattatgctgcgtgacagcgcgcacatccaggaatttgaagctgaatggaaaaaccgcaagggcaaacgcgccggccgcgatccgattgaaccgctttacaccgtggacgacgccgaaaccgctgtcggcctgctttccccgtttgtatacaatcaggtggagcagctctgcgatgggattgccgtccgatttgtcgatgtggggcatttgctcggttccgcaagcattgaagtttgggtgactgaggatgggaatacgacaaaaattgttttttccggcgatatcggcaatctaaaccagccgcttctgcgtgatccggcctatataacggacgctgattatattgttgtagaatctacctatggcaaccgcctgcatgagccgccgcccgattacagcattaatttggcgcagatcatccagcgcacctttgaccggggcggcaatgttgtcatcccatcgtttgccgtcggccgcacgcaggaaatgctgtatttcctgcgcgatatcaaagcgcgggggctggtccatgggcatgacaattttcctgtctatgtcgacagcccgcttgctatcgaagcgacaaccatctttcaggaaaaccgcgtcgattgctttgacgacgaggcgatggagcttgtaaagcacggcatcaatcccatcacctttttggggcttgagctttctgtaacaagcgaggaatcacgagccatcaactttgacaacacgcccaaggtaattatttccgcatctggcatgtgcgatgcgggccgtatcaagcatcatttaaagcataacctctggcggcgggattccacggtcgtatttgtcggctatcaggctgtcgggacgcttggccgctccctgctggaaggcgcaaaaagcgtcaagctgttcggtgaaacgattgaggtcgaggcggaaataacctctttgcagggcgtcagcggccacgccgaccaggccggcctgcttcgctggcttgacgctttccagacgccgccgcgccgcatttttgtcgtgcacggcgagtcgagcgtctgcgaggagtttgcaggcattgtcgcccggcgttacaatgtcccggtgagcgcgcccgattatatggcccgctttgaccttgtcagcaatacaatgcttgatcccggcgtcaagcgcgaggctatgaagccgaagcccgctgtatccgctgccgtgccggccggcgtgtttggacatcttgtagccgcgggcaaacgtttgatgcagatcatcgagcgcagcaagggcagagccaacaaggacttgacgaaatttacaaaccagatcaacgcgctgtgcgacaaatgggaataagggggcgcgcgcgacctgtgcgcaggtcgcccaccgccgggcgcttaggcgcgcgcgacccgtgcgcgggtcgcccaccgccggacgcttcgcttgcccggccggctattcggggctttccggcggctatagccgccgggcacggacaagccgcggcagcgcccctcagcgcgcctcacaaggggagggtcggcgaccctccccttatgttatccccacctgtgggcggcgcgatcgcatcgggcgcacgccggtgcgttctgtggtaaaccgtcaagctgtgcctgccccactgttcgcggcgcagcttgtttttacgcatcggctgccccactgttcgcggcgcagccgattaaagtttttcgccgaggccttttttcaaaaaggccggaaagttttttgccaagctttttttcaaaaaagcgggggtcacgcacgccctcgccgccatggctggacgatcgcgtgtgcgagcacatgggcggcgagcgtgccgacgacgttgatgtcggcgcgcagggaaccgacggacagcgcataaacgctgtcgccgtcggctgtggtgtgcaccgggtctatggcgcgtgcaagcccgttttgcgccatagacgcgattttggtcaattgtgttttatcaaaggcggcgtttgtgacgattgccgcgatggttgtgttgcctgtaaagaagctgcccttgccggagatatcgcggcagagcacggcggtgctgtcggcaaagcccttgccgtcgggcgtgcgcataccggcgacgcgctcatgcgtgtcggggtcaaaaatatcaccgagcgcgttgacgacaaccgccgcgccgacctgcaaatcgcctgcctggacagcaaaaaagccctgccccgccttcatcatggttgccgcgccgccgagcttgccgacggtggcgcccgtccccgcgccgaagctgccgcagcgcgggcggttgttttcctgcgcgtcgagacaggccgcatatgccataccggcgtcagggcgcgcgtcgggcgagccatagccgagatcaaagatgcaggacgcgcaaacaagcggcaccttggcaacgccggtgtcaaacccgacgccgcgttcggacagatagcgcatcacgccacccgccgcgtcaaggccaaacgccgagccgccggaaagcagcaccgcgtggatccgttcagccgcagcccatgggcgcaacagttccgtttcgcgggaggcaggcccgccgccgcgcacatcgacgcctgcgggcgcgccgtccgcgccgccgcaaagcaatacggtgcagcctgttttaccggcctgatcttcggcgcagccgatgcgcacgccgtttatatcggagatcgggatttgccgcaagattatcgccccgctttcaaaaagatctgaaccggccggcagacaaataccgacagtataattgccgcggccaattcacaaagcccattgacgctgataaccgtcaaaaaaacttcttttaaagcaatcgcctggaaaaatatccataagcagccaagcaccatgacagtatgtgaaaccgccgcgacggccgccgccgcgccgatgcacagctcagggcgcataccggcgcgttgggcggctttgtatacgagcgccgcgatcacccctaacaggatacggggggccaggcacatgatcagcgagctgaggggcgcgccgctggcagccggggaaaaaagcaggtcgaccgggccgcccggcgttgtgaccgctttaaacaggctgatgcatccaaagacgccgccgaggatcgcgccgtcaagcgggccgagcaaaatggctccgatgatgacaggtatgtgcatcagcgtgatcgataccggcgggatcataatgaatccgaggggcgtaaaaccaagtaccgccagcaatgcgacgagcagtgaaagctgcgtcagccgtgtggtcctgcgagtggttgccgttgtcataaaaaatcgctccttgctgctgctccatatgcggatgcagcgcgttttatttgtaaagggaagtccccttacataccggtgttctttttccagacagcataaagcccatcgaggcgcagcgttttgtcgacaagaagcttgtgacggcaaaacggtgcgaccgcatcgaccgattcgcccgtcgcaacgatggaagcggccgggccggccttctcctcgtaccgttcgatcatgccgtcgatcatgctggcgctgcccagcagcacccctgatttcatacagtcgatcgtattggtcccaatgaccggcgcgggcggctccaggctgatgtgcggaagctgcgcggcccggttgctcaaagcgtcaagcgatacccgcacccccggcatgatcgaaccgccgataaagctgcggctgcggtcgacgatggaaatttttgtcgccgtgccgaaatcgacgatgatgaccggcagcggatatttttcaaacgcgccgacagccgccgcgacaaagtccgcgccaagctgcgcggggttgtcaatgcggatattcagccctgtttttacgcccggcccaatctgcatgaccggaacggggcttgtaagctggacggctgctttgagcacgggcgacagctgcggaacgaccgatgatatcaccgcgccttttaaattctgctcgcttaagcgatgcagatgtaaaatatggtgcagcaatacggcatattcaacctctgtcttgccggcttcactgacgatatgtgtcaggaacaacaatccgccgtcgcaataagcgccgatattaatattggaattaccaatgtcaatcgataaaatcatactgctttcctgtccttaatcaacggatgtgtaaaacacggctctgcgcctgccagcctttgcggcagggcggaatatgatttgtacctttttgggcggcttctaataacgcgggcggtcaaaggaaagaatggacacaacgctcgcggccacgccgagcgcgcagccgacaatcaacagataaggaatggccatcaggccataaaacgcggccgtgcccatttccaggtaggcctgtaccgtcaccgacaggccgcaggccatcaggaaaagccataccgcgtcgagcgtaagcgatgcgcgccgtccccagagcagcatcgtctgcatgacatagacgacgggaacaaccgccatcagggccgaacgcacccaccaaaagagatcgagctttggcgcaagcgcgccgcccggcccgaggccaaacagcgccaaaagatggcacaccagcgccagaatgagcgaaagcccgcagaacccgctgagaacaaccccggccagcgcgccgccgctcgggcgcgaatcctgtatctcgtcggcgcgctgctgcgcgtcctgaaaatagtcgtgtaaaagcgactgcccgcaatagccgcagcgccgcgcccgtccgctgacaggccggccgcatttcggacaggtaatcatccgtctgctccctcccctgcttatcaggcggcatgcgccgccccaatgtgtccattgtaacacagggggccgccttttacaaggcgcgcagccccggcttgccggggccgcttgcccgccttttacaaggcggcggcccgggcgctacgccctgctttgctccggcgcgggcgctacgccctgctttgctccggcgcgggcgccaggtatgacaggcggcgcatggtcagaagaaacgcgatggacaaaggcacgcaggaaccgatccaggccaggggattggccatgcacgcgcccgcgaaaccgaacatgccggccagcacgagcgcggccagggcgcgcatacaaagctccataatcccggcaaaggtcggtacgaagctttgcccaagcccctgaagggtgtaacggaagataaacagcagggacaggataaaataacaggaaccgttgatggccagatagatctgcgcggtttcaatcacctcaggatggccgacgacaaacaacccgatcaggtttttcccgaaaacattgttgacaatccccatcacaatgctgaacgatacggacatcatcgcgcattgcagcacgccgcgccggatgcgcggcacattgcccgcaccgtaattctgggcggcataggtggccatggtcatgccgaacgacatcatcggctgcgtggcgatcaaatcgattttctgtgcggccgtataggcggaaacggcggtttctccaagcccgttgagcgtaaactgcaaaatgatggaaccgattgcgatgatggacgattgaaaacccatcggaagcgcgacgcgaagatgctcaaaaatttccccgcgtgtgacgcgccagtgttcgcggcgcagatgaagcatgggaaaacgccgggcgatataaacgatacacgcgccgccggaaagaagctgcgcggcaatggtcgccacagccgcgcccgccacgcccatttgaaaggttaaaatgcacaaaaagtcaagcccgatattgatcaggcaggcgatcacaagaaagatcaggggggtacggctgtcgccgagcgcgcgcagcacgcttgaaagcagattaaagaggacggccgccgcaatgccggcgtaaatgacgacaatatagctgtacgcgccgtcgatgatgttggcgggcgtgcgcattaagacaaggatcgggcgcgcgagcgccacgctcaacgccgtcagaaacacggtgatcacgccgccgatcaggataccggccgcaaagctgcggcgcacgccttcctcatcgccggcgccgaaccgctgcgccgtcacaatggaaagcccggcggtcagcccctgcgtaaagccgaggattaaaaacatgatgctgcttgtacagccgacggcggccagcgcatcgacgccgatcgtgcgcccgacgatcagcgtatcggccatgttgtaaagctgttggaacaggttgccgatcagcagcgggattgtaaaaaacaggatgagctttgctggattgcccacggtcatattttttgtcattctgcatgaatcctcatttcatattgcaaatttccagtgagatcattttacacccggcgcgtatttcgtcaaggggtttttataaattcggcatacgttacagttcgcgcggctccgtccggccgttcttttggcttattgacgcaaataggcattgtaaaggccctgtcccccatgatgcgaagctgttttttgctttaaacagccaggccgccgccggaatgtgttccggcggcggcctgacccgacaagaggattcgctttacaagcaatcatgcatgattgacgttcagttgatgcattctcacggattgacgacgtttaccgggctgccctccaggaatctgcgcagattgtcggcggcgatctccatcaggcgctggcggctctctttgggcgcccaggagatgtgcggcgtaatcaggcagttttttgctttcagcagcgggttgtccccccggatcggttcagttgagacaacatcaagaccggcggcatacaccttgccgctgttgagcgcgtcggcgaggtcctgttcgacaatcagcggcccgcgcgcattgttgaggataatgactccatccttcattttggcgatgttttcccggttgatgatcccctgtgtggaaggcagcagcggacaatgcagggcgatcacatcggagcgtgcaaacagcgcgtcaagcgcggtatattcagccagcgcgcggccggcgccgctttcatattcgtcataagcgatcacattcataccaagcgcccttgcaatacgcccggtcgtctgtccgatccgtccaaagccgataatccccatcgtcttgcccgccagctcgatcagcgggtaatcccaaaaacaccagtcggcattttgttcccagcggccggcgtggacggcgtcgctgtgatgagcggcatggtggcagatttcaagcagcatggcaattgcaaactgaccgacagccgccgttccatatgccgggacgttgcagaccacgatcccgcgttcacgcgccgcggctatgtcgactacattgtaacctgtcgccagaacgccgataaactttaaatcgggagcggaaaaaatcgtttcacggtcgagcgcaaccttgttgacatataccgcgcctgcgccgcgtatacgcgcggcgatctcgtcaggcggcgtgcggtcgtataccgtcagctcgccgagcgattcaagcccgttccagcttaaatcgccgggattttccgtataaccgtccaaaactacaattttcatctgccggtcccctttactgctttgtatgttcatccagccaggcgcgcatggaactggcgcccatctgcatcaggccgatatcgctgctgcacatattgaccgtcataccggcttttatccagcgcgcgagcggttccatgccgccaaaatgcgtgccggaagccttcccggcgtcttttgcggcccggatgacgcgttcaaacgccgcggcaatctccggatggccgtactgcccgagcaggccgtaatcctgcgacagatcgttcggccccataaacgcgatatcgatcccctcgaccgccaaaatttcctccacgcgctccacgcctgcgcgcgattcgatctgacaaaacagcagcgtttcttcattcgcccgctccatatacgcgcggccgtcgaccttcataaagtcagtgtgcggccgtgacagcgacacgccgcgacggcccatcggcgcatattttgtaaagtcgaccagctttcgcgcatcctcggcgcattccgtattgggcagcagcaggccggccgcgcccatctccataaatttaagcgctggttcgcgcagtggtccgggaatgcgcacaatcgccggcaggccgatcgaacgcgccacgccgatcatccgcgaacagccgtcataggaaaaagaaccatgctcacagtcgatgataaagaaatcaaagccgcagacctttaatatttttgcaagatcgggggtgtcaaaggtcgtcaccattgtgccgaggacgcgctccccgctttggatacgttttttcaaattcatagctgtttcctccatcgttgtattgccccggggggcgcgcgcgacctgtgcgcaggccgctcaccgccgggaggcgcgcgcaatccgtgcgcggattgctcaccgccgggcgctgcgcttgcccggccggctttggcgcgcgcgacctgtgcgcaggtcgcccaccgccggacgcttcgcttgcccggccggctattcggggctttccggcggctatagccgccgggcgcggacaagccgcggctgcgcccctcagcgcgcctcatgggacaggggcgggccgcccctatcccatggacccaaccctggggcaggcgcagcctgtataaatgctggaacccgccccactgttcgcggcgcagccggttaaagttttttgccgaggctttttttcaaaaaagcgggggcttttttcaagaaagccggtgcatgagggcctcgacctcggcgctcgacggcagcgcccggccgatggaaccctgttttgtgacagccagcgaaccggcgcagttgcaaaacagcgccgtccgctccagatcgtacccttgcagcacgcagtataccagcgccgccgcgaatgtgtcgccggcccctgtagggtcgattgccggaacgtcaataccgccggcagttacgatttgcttgccgtcgctcacgatcgcgccgtttgcatcgcatgtcagcgcgatcacgcgcggcccccaggcgtgcagctcgcgcaggatgtcgtgcgggtcgtcaagcccggtcacaaaccgtgcctcgtcgagcgtaggcgcgatgatatcggccgagcggatcgcttttagcagacggtcgcgggcctcgtcgctgcccatgacctccttgcggatgttcggatcgaatgaaacaggcacgccgtgtttgcgcgcgatacgcacgcattcctgacaggcggcgcgcatttcggggctgacctcaaggagcatcccggcatagtggatggctgacgcgcccgcaatgaacgtttcgtcaatatctgctggcgacaggcggctgccgacagaatttttgcggtaatattgaaaattgcggccgttttcaagatattcgacaaaggaaagaccgatctgcccttcatcggacacgacaatgtgcgaaacgtcgacgccctcccgtttcagcgcgccataaacaaaatcgctcaatccgtcgcggccaaccttgccgaaaaaggccgcgttgccgccgagccgcgcataagcgcaggcgacaatcccgcaggaaccgctggctgtcttgataattgcgccttcctcacagatgcgcagcttcggttccacagggatacattcaacgagcaattcgccgatagaaataaacggccggccggtttttgcatgctccataacttttgcctcctattaataatattaatcaatttctattaattgagactttgatcttattatagacctgcacatgaaacgtgtcaacagttttttgttttgcgctcatatgacagccagtccacactaggggctgtttgaaaaatcggaaataccgtctttttctacaaacagcggtgaatccagcgttaaaaagcctcggaatccgaaaggattcctgtgttttttgccttgtattctcctgctgtctgcgaaaaatccggcaattcctctattttcaaacaagccctaaatttatttaaaaatataggagcattctacattttttcagacttttcccttgacgaacgatgatcgtctgactaaaataataactaataattattaatggagaaggtgtgatatgaagaaaccgacatcttccgatgtcgcgcgtgcggcaggcgtttcacaggcggccgtctcgatgattttgaatgggaaaagcggcgtttccttcagcgccgaaacgcgcgcgcgcgtgtttgacgcggcgcgcgcgcttggatataatctgccgctgcaaagcgctgtagattctgacgggcgtctgcttgccgtacttgtcccaacgctttccaatccatattatacgcagcttttacaggcggttgaggaccaggcggccgcgcgcggctttcgaacgcttttttgcaacacggcgcgcgatgcgcagcgcgaagcgtattatcttgcgttgttcaggcgcagccgcgttgcgggtgtgatttatacgttcctgcccgccttcccccagcaggccgaacagcttgcacagacaattccaacagttttgatcggtgaaaaaaataccgggcaaacattgccgtccattgaactgagcaaccgcaaggccggcgcgaccatcgcccgccatcttttaaagctcgggcaccggcgcgcggcgtttctgtccacgcctaccaaaaacctgacgcttgcgcgcggtcagagattggaaggcgcgcgcgcctgctttgagcgcgagggcggcgaactgctcacgctttttacagacgatgtgtccgagggggattttgacagcgaaccgtacgaatttgccgccggcgagctgctggcgcggcgcctgtttacacagacgcatggcgttacggctgtcatcggcgtcaatgatatgaccgcgctcggcgtcctttcagccgcgcgtgcgctcggcgtacgcgtgccggaggactgctccgtctgcggatttgacaatatttttgcggcgcgtacagctttcccggcgctcacgaccgtcgaccatcatctcgacctgcgcggccgcgccgctgtcgatatcgtgcttggcgagcgcggcgcgctttcaccgcaggtcagccggattgaatatgaaccgcggcttgtggcccgcagttccacaggacccgcgccgcagtaacgttcatattttttgcataggaattgccccgcccatctgttataataatcataccggcttttttgaaaaaaagcctcggcaaaaaactttagtcggctgcgccgcgaatagaaggcttggcgcgtcgcaaaacaaaagttttcgcccgcctttttcaaaaggcggcgggtgaaggcggaggccaaagccccttgcgggctttggcctccgccgagggcagcgccctgaaccccgggccgcagccctcataaaaagcgcggcccgcaggccgcaagacacctgttcaggcgcaccgcctgcccctagcaaaatccatgacagacgctgcgcggctggcgtggattttgccagctcccaccttccgcttttcccacttttccggcctttttgaaaaaaggtatgccaaaaaactttagtcggctgcgccgcgaacagagggacagattccggcgtttttacaggctgcgccccgggcgcgcgcgccttggtgcacaggtcgcgcgcgccacagaaaggatggtcaatttgcctatacgcaagctgcgccgggcggcgctgcgcgcgctctccagtccggcctttgatatccgcaaaatgtataaagccgtccgctccgtgcagacggcggcgggaaggccgccgcgcctgttttacaagccgtgggaccataccgtgcgcgtggacgggcggcgagtgccggtgcggctgttcgcgccgaaaacaaacagccgcgattccatcctgttgtttttccacggcggcggatgggtgacaggtaacatcgacagctatgaccgcgtgtgcgccaatttgtcgaatatcacaggccgcatggtcgtgtcggtcgattaccggcttgcgccggagcatcgcttcccggctgcgcctgaggattgctacgccgtggcgcgcgatatttttaccgatctatcgctgtttatgatgacgccgcgtcaaattactctgatcggcgacagcgccggcgcgaacctggcggcggctgtctcgctgatggcacgcgaccggggggaatttctgccggaaagccaaatcctgatctatcccgcgacagccgcggaccacgggccaaattcgccctttccttccgtacatgaaaacggcgagggctatcttttaaccgcgaagcatattgaagaatatatgtcgctttatatctccagcgaacaggaccgctgtaatccctatttcgcgccgttggaggcttccgatttgtcgcggcagccgcagacgcttatcctgacggcgcagtacgacccgctgcgcgatgaaggcgaagcgtatggcgaacgcctgaagctcgcgggcaaccgcgtggagatgcaccgcatcccggacgcgctgcacggctttttttcgcgttcgccgcgcactcaggcagccaggcaggcatatggatatatcaaccgctttttatgcgaggtgacgcatacgtgaaacgacagaaagccgcggcctggacccggcttgacaacgccgccaaaatttttccctccaccagcagcaaggccgaccccaaggtgttccgctttgcctgcgagctgacggaggaggtggacccggatatcctccagcaggcgcttgacacagtgattgaagcctttccggtctttcgcagtgtaatccggcgcggcctgttttggtactactttgagacaagcgccctgcgccccgttgtcgcagaggaatcacagccgccctgccggccgctttatgacccggtagtcaaaagcttattgttttccgtcacatattaccggcggcgcatcaatcttgaaatttaccacgctctgaccgacgggaccggcgcgctccagtttttgcgggcgcttgtgtgccgctacctgatcctgcgccatcccgaacagttcggggacaatccgcccgtgcttgattacgacgcgtcgctgaccgagcgcacggacgacagcttttacaagcactataaccccgatacaaagcggcgcgccaatatcaaaaaaacgccggcatgccatttaaaagggccgcgcaatccggattattttctgcgcgtcatcgagggtgaagcgcccgttgccgcagtcgcagccaaggcgcgtatgtatggcgcgagcatcacggcgtttttgacggctgtattgatctgcgcgtttcatgaggtcattcccgcgcgccggcaaaagaaaccggtcgccgttgccatcccggtcaatctgcgcaattattttgaatcggaatccgcccgcaatttttttggcgtgttcacagtcggctacacctttcacaagcaaagcgaccggcttgaggatgtaattgcctccgtggccgcgtcgtttaaacgcgagctgaccgcggaaaacctcagccgccggatgaacgcgctgcttgcgctggaacacaacccgcttgtgcggattttgccgctggcgctcaaggacccggtcctgcggctgtcggcgcttgtttcggagcgcggagaaacaacgtcgctttccaacattgggccggttacaatgccgcccgagctgacgccgtttatctcccggttcgacgcgtttgtcggcgcggaccggctgcaaatggtcatgtgctcctttaacggcaatcttgttatgagcattacgtcgccgttttccggcgccgatgtgcaaaagggttttttccgcacgctgacggaaatgggcgtcccggtgacaattgcggccaatacgcttgacgaggaggaataatccgtgcagtactgcgaaaaatgtaaagtccatgtgcgcggcctgcacgcaaactgcccgctttgtcaggggcctttgacaggcgagggcgaaacgccaaacagcgtgttccctgctcacacatatcaggcgccgcgttatcacctgctgatccgttcgatgatctttgcctccattgccgcgatcgtcgtctgcgccacggtcaatatcctgcttggcgggcggcgctggtggctgtttatcgcggcggcagtcgcctgtatgtgggtctgcctttacagcgtgatccgccggcgcaacaatatcccgaaaaatattatctggcttgtattctggctgtcactcattgccgtactgtgggatttgttcaccgggcggcgcggctggtccatcgattatgtcatccctgcaatctgcgtgctggccatgatcgcaatggccgccattgcgattgttctgcgtctgcgcattgaagaatatatgatctatgtattgctcgacggcctgttcggcatcgttccgctgttgtttttaacgcttggatgggtgcgcgtatcgttcccttccattctgtgcgtcgcggcaagcatcctgtcccttgccgctctgctttccttccagggcgaaacgctgctgtccgagctgcgccgccgcctgcatctctaagaacctgcaaggatcgatcaatatgaaaaagcttcttttcgcaatcaatccgcacgccggcaaaggcgaaatcaaaacaaaggcgcttgaagtcatcgacctgtttgtgcatgacggttatgaagtaaccgtgcatacaacgcagcgccgccgtgaaatcacccacctgctggccggccgcgccgcattgtatgacctgatcgtctgctgcggcggcgacggcacgctcaatgaaaccatcgacggcctgatgcgctgcgcgcagcgtccgccgcttggctatatcccggcgggaaccgtcaacgacttcgcttcaagccttgggatctccaaaaatattttacaggcggcgcataccattttgcaaggcgtgccctttgcctgtgacatcggctcgttcggcgcgcggtatttttcctatattgccgcgttcggcgcgtttaccgatgtggcgtatcagacgccgcagcaatcaaaaaatatgctcggccgcgcggcgtattttctcgaagggatccgccgcctgccctcaatccatccttaccatatgaaactgacgcacgacagcggcgaaatcgaaggcgattttttgtttgggatggtatcaaacgcgctttctgtcggcggtttcaagctgcgttccccggaaatccgcatgaacgacggcctgttggagctgctgcttgtacgcgatccgaaaaacgccgctgaagcgaccgccatcattggagcggtgctggggcgtgatttcagctcgccctatatcacaacgctgcgcacaaagcaattgtccatttcggccgccgaggcggtcccctggacgctcgacggggaatttggcggtaaagttgaaaccgttcaaattgaaaatcatcacgctgcgatcactgtcctgacaaacccatcgccgcccgcgccgtaaccaatagacaaaagccgcccctttcaccggaatattccggtgaaaggggcggcttttttccgtctcccggacggctgtcaaagtctggcgcgcgcaaagacgccatgcaagagctaagaccccctgtattcacagccgaaggatgcagggcaggcggctgtgaatacagattctaaggcaggctgttgccctgaagcacaagcgcgcgcagcagcgccatgcattcgcgcacccaatatgacggcagcaggccccacggcgttgtagatgaaacagcggcgcacggctttaacccggcggcctgcgcatagatcgcgccgcgaagctggtgaaagccatctgtcacaatcaaaagctggcgcggcaggtcctcgtgtgtgatcagttcaccggcaaagcgcaggttttcgagcgtattgcgcgactgatcttccatatagatctggtcagccggcaaaccgcgcgcaatcagataatcgcgcatggcaaccgcttcgctgatcgtttcccctctgtcgacgccgcctgtcacaacaacgggcgtgtcagaatgagccgccagatacgtatatgccgcatcgagacgcaggcgcagtatctgcgacggcttgccattgacactctgactgccgagcacaacaactgtgtacgattcgccggcacgcggcggcataaaccaggcgtaacgaatcatcagcacggacagaacagcgccggtaagcacagcggccgcaagaacgaaagacacggccagacgcagccagcgccaccaacgggccgcgcgtaccggcgtcgggcgcgccgcgccaaatgataggctgcggtgaatccgcggcgcgctttccacagcgggaaatgcatcccacaggaccgccagcgcgcacagcgccagcccaaataatataagcgtcaaaacgccggtgttaaacaccccaaagggcatcggcaaaatgccgcaaatcattgcaaatatcccaataagaaccgcgattcttttaaatgctgatttcataataggcctctgatgaaaaaatttcaacatgacagccgggcgcgcgtgacccgtgcgcgggtcactcaccgccggacgctgcgcttgcccggccggctattcggggctttccggcggctatagccgccgggcgcggacaagccgcggctgcgcccctcagcgcgcctcatgggacaggggcgggccgcccctatcccatggacccaaccctggggcaggcgcagcctgcataaacgccggaggccgccccgctgtttgcggcgcagcctgtataaacgcagtgcccaccccactgtttgcggcgcagccgactaaagtttttcgctgaggccttttttcaaaaaggccggaaagttttttgccaggcttttttcaaaaaagaggggactgaaaacgcagcgcggcaatctgttcgtttgtagggattgacgggatggcgccgcgcccggcggcgcaaagcgagccggccgcgtttgcgaaatcgagcgcgtcggcaagggcctggctgtctccttccaggcaggacggctgatcaagaaggcggcagagcagcgccccccagaaggtgtcgcctgctccggttgtgtcgataaccgttgtctgataggtcggatatgcgcccgtttggccgccgcagcggtaaaaacagccgcgcggcccgagcgttacaacaatcagcttcattgcgccgcaaaagagctttttggtcccctcctccggatccgcggttccggagagcagttccagctcctcctccgacagcttgaggatatttgtatagggcaagccaagcttcatgccggcaattccctgttctgcgctgctccaaagcgcagggcgccaattcggatcataggaaacaagcttgccgtgttcaaacgcataccgcgccgcataaagcgtggtggaacgcgacggttcagcggacagggataccgacccaaaatgaaaaatccggcattcatcaagcaaagcatggtcaattgcgtctgtttctatgcactgatccgcgccgggtttgcgcgcgaagctgaaggaacggtcccccgccgcgttgagatggacaaaggccagcgttgtaaacgcatcctcttttacctggattccggaagggtcgatccccaatccttcgataacctctgtcagcgaccggccaaactgatcgctgccaacggcgctgatcagcgccgcctttttcccaagacgtgtgacagccgccaatacattggcaggcgcgccgccgggattctgttcaaataaagggttgccctgctgtgaccggccggccggtgtaaaatcgattaaaagctctccaagcgccgtgacgtcgatcattatattcacctcgtccttttatttttccagtttaccatagtctttccaggaaagcaaacatggcgcgagcaatccgtgcgtcacgcgcgccaagagaccttttttcaaaaaagcgggaaaattgcgtttttgcgcaaatttggggctgtgcggcggtatgggtaaaggggtgtttgacagatgacaaaacagatgacaaaccggctgaaatttgatatgataaaggtattacaaaatggccggcatggcgctttgctcctgctgcccacgcaagaggtgatttatatggcgaatgcgggtatgaaaccggccgcgcccgctgattacacaagcgcgctttcagaactgctgccgcaactgattgaaaagtattcgcgtgaggctgtcggggattatatgaatgaatgcagcgccaagcttgcgcgcgttcaggaaagcaacgcaagcctgcttgacgtcggttcagatgaagccgcgcagtcagacgcggttaaacgcgtcgttgaagcgacgggcgattattatgcgtttttggcaaagctccccgaggatatgcgccgctttttaattttgatgggcggcgttacagccgacgaaattgacggcttgcttgaaattgaaccggatgtacgtgaggaaatcagtctgctggcttccgtcgcgcctgcaatccaggcgatccggcccaaaaattatattatgccgatcgacccgatcacaaacaaattggcgcagctcaaggaatttaatgagattacagtcgcgcgccggaaaaatctgacgattcagacggccgtcaccatcgacagcccggaacatatgcgtatcgatggcaattttcagcttaccaactatgataaaagcattatcaacggcatcgtatccattttggaaagtggaaactccagctttacggttccgatgctttaccacgcgatgactggaaaggaaaacccaaccgttgacgacggacttgtcgaggagatcaaggcaaagcttgacgcgatgcgccgcctttcgatcaatatcgatctgacagaggagatcaaggcgcatatgatccgccgcaatatcgacggcgctgacggcgtcgattcctttacaatcgacggctatcttttgcctctcaataaatatacaggcgtggtcaacgggaagcgcagcgaaatgtatcagattatcgacacgccgccgctttacagctacgccaagctgaaaaatcagatcacaaccctgccgattgatctgcttaaagcgccgctgaacaacaacgcgacgaccattcccttaaaaacataccttctcagccgtattgaaggcatgaaaaaccaaaacaatcgtctgacacgcgacaagattttatttgaatcgatttatcgggagcttggggaccttgaatcggacaagaaacgcaaaaaacgtatccgtgattatacggagatcattttaacgcattttatcagtatgggctatatcacacggtatgagatcatcaaagagggccgcaccatcacaggagtgcgcatccactgggaagataaaaaataaaaaaacaggagaggcattgcctctcctgtttttttatagattgctttgcaatctataaaaagttggaatttcaggctgtttttggcacgaaaccgcttgataaaacttcgcctgtagaacggggcggccctcgccttttgattccggttgtgccgccaaaggtagtgcaagaccattttaccatgcatttgcatagtaaaaatagttgcttttagccggtcagcgcgcttgatacgccgcccccaaaaatcatcgtatacggcacgagcagcaagcggttggacgacagcagaaacatataatagtaaaaacagccggccataaaaagccccatcgctgtataataaaccgcacgttccccgcgcaattgcgcgcgcagtgtcccaagcttcgaaagctgttgttttttttgctgcttgtcaagcgtttgcagctgggcatatctgctttcgtcaggtttaatactgtagagcatctccggcaataaaaacgttgccacgggcaaaaacatcaaccccacacgctggaaaataaaatgcttgagcgtcaggataaacaggattgacgcatagacataaagatttaaaagcacgatatttttaggatcacgcgccaatacacgctttttcatcaacagcgcgacggctaaaaataccagaatcatcaatgccgtatcaaagctgcggccccgtgtataatatgatcccggcgtatatgctttaaagacatactgcgtgacaaatccaagaataggcacagaaaaaatcagcacaaaaagcgtcccggcggcataaaaggatatacttttccagttcagtgggatcaccgcaaggaaatatacaggaaccatcagccaaagacttttatgaaaagacgccgcaataacaatgataaccatataaggaaggatttttcgatccttcagatatggcaatgcaaacagcataatggaaatcgcaagctcctgacgcagcgtacacatcgaataaccaaagaaaccaaagctgatataaacaaaaacgctgaaccagatcgaacacgattgcttatagatggtgatggcacgcgggataatgataaatacgggaattaacgccatataaatggccgcatcctttgtcacaagggaaaaaagataggtcaaaaggctaaatcccggttcaaagcggtaaatgttatttggagaaaataaaaacgaaaaggggttttggctgactgtctcaaaataagcctgataggttggataatcgacgccgaccattgaggaccgcagcagcaccatcaagcacatcacagcggtcattgcatataaataccaaagattcgccgtgcgtgacggtttccattcgcaaagcagcaagcccccggcgccggcggccgctaacaaaacaatatatgggagcaatccgcatcctccattcattgaatcgtccgtttcggacatgctttcaaggtctgtaaaggtttttccccttatcatccgtcagtcaggctgttcagacaaataaaagggcgcagtcaaaagcggttccctgtacatgtaccgtaacaaagaaaacgccgcaactattttttcctgattacagcaaaaaaatcacaagccttgaaactatgtccgcaagaaaaatattcgctccctctctgcgcgccccgcgcgcagggagggagcgaacccaaccgcacatatacaagcggaatttccgcttgtacatgtgctttattcgccgagacagctttttatttgtcggtcaggggcgcatcggtaataatgaggctgccgccaaacggagccgtcacatgcgcgtaaccattgacatcaacaaagaagttcggagccgcaacgcgtgtataaacgttggtagccctgtcgtaggagtaaacgacgatcgtgtcggtattcagcgcggaaagatccagcttggcgcagaactcggcgttcacaccggccagcgggcttgcctcaccataggaaacaacgacgatatcgtttgtgaaatacttgttgaacctgtcaagcacgctcttaacagccttgtcggtcacatcataggaaaccgtcgtgttgacagtctcggtaacgtttgccagatcagccggatcaagtgtgatgcgggtgatgaccttaccattgacaaccttgtcgatgttgatcgtcaggttgacatcgacgccggacttcgcttcagcagcggcaaccgcatcgttaatagccttgatggccgcaggagacaggctgttcacattgttgaaggtaacagaagcgttcgcactgctctggccggctgcctgcgcgtcagcgatcgccttggtggccgcatcagaggcagcttttgaagccgcagccgcgctcaacgttttagccgcaccggtattggtcttgtcgctgacgatcccgagcttggagccggaggacgaaccgccgccaccaccgttgccgccgctgataataccgctgtcctggggattaccgctgtcctgattaccgctgtcctgcgaatcctgtacagcagggctgatgccttccgctgcgctgaccatgaccgcgcagctaaacagcatgcagacagccaggataagcgccaatgcttttttcattgttgatacactctcctcttttccgattttggaatcgaaatagattttttatgtcatcaccttccacgggcgatatgacatcattgtaatatgcagactcccggacgcacacaagccaacaaggtcaaatggatgagcgtctgttttttgtgcctgtccatttcccctattggtatatttttcattatctcattataggttttcaatcgcttcttgtcaagcaattttcggcacatatcgagcatatgggcgtataatcgggtgcgtatattcatagaagttttggaggaaatgacaatttcattatgaagctcctacaaggccgggtaaaatgggcggaccggcccgcaggccggtccgtccgtggctggagattatatcaatgaaaggggatgtttattttgtgctgacacgttcattcgacaaaatgtaagttgtcagcgtccttgtttgaagttcaaatgtatcatcatcttcattatacgtaaccgtgcgtgtgatatcacgcagctttcccttgctgtccgccgtataaatatagacatcgtccgggtcgatatcgctgtcaaacggattgttgagcgccagcgttgcccggccgctggcagggattgttgcggctgtaaatttgcggatcactgcatccgtgttgtggaatttcgaacttaaagagctgggccattttgtcgacatggccgcataaaatttggaagggttgctgttcgctttataggtcagcgttgcatacgtgtcgctgccttcaaaaacaacctcgttggttacatttttttccgggcgaatagtaacgcccttgttgccgacggttacgctcgcgctatcgccgtcctcctcttgatttccgacatacagggttccggtcagcgtcaatttatcgccggatttaccattaaaaaactgtgtgtagcgtgtcacgccgttttccgtcacttcgtcgttttttgtgtcggtgcgctttccataacagagcacagccggcttgcgcgcggtaaatgtcacagaaaattcgatcttctgttcatccacgcccgtcatgtcgttgagctccagcgcaatatagctgttgcgctgattcgtataaaactgagcgtaatcattgcttgtgggattctgttgattggggacataaattgtatttttagaggaatttgtcagctttttttcaacaaccttgatcgatttgatcagcttggagtttttttcctttcttgtggaaatacgcacatcctttgatgaatccgcccaatcggcaagcgtcacgggcagggtaaaatacaccgtttgtcccggctgggccgtatccccgatggaaaattgcccgccgtcttcattcagcggatttccagtaatattcgtaatttgataggtgcgcgcgccctgatcgatggcaaacgccggcatttgaagcgacaggacagccgcagccgacaaaatacctgcaagtatttttttcatgatgctttctccctttttcttgatgggtctggatacgccctctgtataaagagtgcgtttatatggaagaattactgcatattattttccttttttatttggcctgtgatctttatacgccgggcggctttagcgcgcgacccctgcacggtcacagcggcgccggaaactatagcttccggcgccttcgcgcggctttccgaagcgcgtcggctgccccgctgttcgcggcacatctgactaaagttttttagcataccttttttttaaaaaaggtatgctgacagctgcgtaatgaaagggatagtcaaaatggaaaacagcgtggtaacggcgaccagccgcgcgccgagcgcggcgtccgcgccgtagcgcgcaggcatcatcacacaactgatcgccgtgggacaggcgctcgcaatcataattccaagcgaaactgtttttgctccatcaaaccaggaaggtacgcgcagcgccacaagcacagccagcatcaaaagcggcagaatcaacagccgcatcgcggccgtgagccacaggcggggatcgttaaacaacgttttcggatcaacctccgcaatcaaaattcctgtgataatcattggcagcggcgtatttaatcccgcaagatatcccatcgcatcgtgcaaaataccaggcagccggatgcgcagcaaaaacatcgccgcaccaagcagcgctgcaacaacgcatggcgtcaggagaaattcgcgcggcttaacccggcgcgtccgccgcagaatcatcacgccgtgcgaccatatgtaaagattgaacaccgcaatataaaccgccgcaaccagcgcgccaagctcgcccatgacggcgctcatcagcggaattcccataaaaccgcagtttgaacagattgcggacagccggcccacagaatcataatcattgcgcattcccctgaacacaagctttgtaaccggaatggataaaaggtgaaatactgccgccaacagcgcagttgctgcaatcaacaagcccagttctggttcaaaatcgcgctgaaacgattgtatcagcagcgtaggcgtgacaattaacagcacaaagcccgaaaactgcccggccgatacttccgaaacgatgccgcgcttgcggataaaaatcccaacgccgagcagtataaacattacggcaacctgttctgccaatttcagcgccattcttcaccaattcctttccagggcttgtttaaaaatagagaaatttttggatttttcaaaccgcccctggcgcgcgattgcgcccttttatcttattccgcaagctccgcccattcctcgataagagcgttgagccgctctcgcgtctgttcgagctgcgcgcagacttcggacaccttttgatagtcgcttgatatctcaggcgcggccagtgaagcctgaagccgttcgatctcgtactcgtgatcagaaatcgcctgctcgacttcgatcaggcggtttttacggcggaccgcttcggcgcgctgctttttgctgcgatgatattcgccggcaaagcttcccgccggcgcggggcgcgccgcctgttccggcgctgccgcgggaaagcccgcggccggcgcgccggggcggcgcgccgcaaggtatgcgtcataaccgcccttataaagcgtaaaaccttcctccgtcatttcagcgatgcaggtcggcatccgcgagagcaggtagcggtcgtgcgaaacggcgagaatcgtgccttcataccgcatgagcgcctggtcgagcacctcgcgcgtggccaggtcgaggtggtttgtcggctcgtcgagcaaaaggacattgccctcctcatacatcatgatcgcaaatttcagacgcgccttttcaccgccggaaagcatttcaacccgcttataaatcgtctcgccggaaaagcgcaggttcccaagcattgtgcgcacatcgcgctcataagccgccgggaaccgatcccacagctcggcaagcgccgttttgcccggatgcaggtcaagctgttcctgttcaaaataggataccttcacattgcggccccaacgaattgagccggcctccggcttgagccgcccgagcagggcctttaaaaaggtcgatttgcccacgccgttgcggccgacaatcgctattttttcgccgcgcatcaggtcaaaatccacagtttggcacaatatccgtccaccggccgcgccgcccgcgcgcagcgtcaaacccgcgacatgcagcacgtccttgaccggctcctgctcaaaatgaaaggcgatgcgcgccggcgccggcggaggcggcggacggtcgagcggctccatgcgctcaagctgcttttcacggctgcgcgccatcgcaacggtcgaagcgcgcgccttgttgcgcgcgatataatctgtcagctttgcgatattctgccgctgcatctcatattccttgacagcgcgttcatacgccgcctcgcgcgtatgcatatactttgtatagttgccgcggtaggctgtcaggcgcagattagccacatcccagatgcgcgtgcagaccttatcaagaaaataacggtcgtgtgaaacgactatgagcgccccgcgccacgtctgaagatactcctccagccattgcagcgttataaaatcgagatgatttgtcggctcgtcgagcatgagcacatccggctcgtcaagcagcagctttgccagcgccagacgcgtcttttcgccgcccgaaagcgtaccgcagacggtatcctgatcacggccgccaaaccccatgccatttaaaaccgtattgattttgacgtcgatgttgtagccgtcgtttgtctcaaaataggattgcaggcggccgtattccgcggacaaagttttataatcgccgcctgcgcggtccgcaagcgtttccatctgcgcggccagacgtttggcctgctcctgcgcgtcgagcagggggcggaatacgccgcgcatttcctcgcggatggtgtttgcgctttcaatcccgctgttttgacgcaaaaagccgatgcgcaggccgccgcgcacggcgcgttcgccctcgtcgggcgcaagcgagccgtcaagcacgtttaaaagcgtcgatttgcccgcgccgttgacgccgacaaggccgatgcggtcgccctcctccacatttacggagacgttcataaatataaccttatcggcaaataatttactgacatgatccagactgatgagcatacgttcccctctcccccgcgctcattcgtccccgccaagcagggctgccgcgtccgtttccggcagctcgccgacctgcgccaaacgccggcggatagcgcgtgtgcgcacgccgacaagcttgtcaagctcgctgcccgcctgttccagacgctgctgtgtcgtttcaagcacgtcgccgaagcggttgaattccgttttgactgcgccgagcacctgccagacctcggccgaccgcttttggatcgccaacgttttaaagcccatctgcaggctgttaagcagcgcggccatagtcgtcggtcccgcgacaaccaccttgtagtctcgctggagctgttcgaccaggtcaagctggagcacctgtgcatacaggccctcaaacggcagaaacatgactgcaaaatcggtcgtatgcggcgggtcgatgtatttatcgcggatatcgcgcgcaaacgccttgacgcgtgtctttaacagcctggccgcctcgtcgattgcttcgcggtcgcccagatcatacgcctgcgtcaattgtatataagcgtcggccggaaatttcgcgtcaatcggcagatagacgggcgtctccccatcccccggcaggaccacggcaaattcaaccgggttgcggctgtcgcgccgcgtcgcaacgttcgtttcatattgaccgggcgcaaggatatcctccaaaatcgcgccgagctgcacctcgccgagaaggccgcgcgttttgacgttcgaaagcacctttttcaggtccccaactccagccgcaagcgtctgcatttcgcccaggcccttgtatacctgctcaagccgttcgctcaccattttaaacgattgtccaagacgcgtttccagcgttttttcaaggcgttcgtcgaccgttttgcgcatctgctcaagctttgcggcgttgtcctcctgcattgcggacagcctgttttcgaccgtcgagcggatgcccgaaagctgctgttcattctgcgccatgaattgggcgaaccggccgtcaatgccgcgcgtcagctccgcaaccgttttctgcaggctgtcctgccggattgaaagttcgcgcgattgctgctgctgaccggcagccagcgtccgcccgagcgattcgaccgcttccatcgccgcccggctgctctcctggcgcgtttggcgcgcttcctccgacagcgccgtgcgctgccggtccagcgcgttataaaggccgtccatatcggtccttccattgccggccgctttggcggctaaaatggccgcggctgcggccgccaataaggaaaagagcgtcagcagcagcaggataaaaagaaagggttcctgtggcatgatgtttcctccaaaaagaatgcccgcgctgcgggcgtttcgtatttttttttaccggccatgattatatggcggctgcaaagggctcagccgtttgtactgcgcatattatagcataatttttccgccaggcaaagctatgtttttgcgctgaaaaccgggggcctcccttttgtaaaaggaggccctttttaatgattgatacagtacttacattacttacagtacctacaaacggtggattcaggctgaaaaactgggcaaaatcccctttggtacgctgttttgcagggatcttggtgtttgtgtcacggtggtcggtttcggtttgtatggtggtcggttttggtttgcacggtggtgtgattcggttagtttggtggtgtgattcggtttgttttgccggttggaagttatgttatactggttacaggctgctaaaggcttgctccgtttatttttttatgtatgaattgaagcgaaaatcgatgaaaacagaagatattgtgaggtcatttgttttttagaaaaaaggtactcagtttcggttagtgtgtaccaatatgtgatcagcttccctttttcgatcttttacagcgtttgcctgtcctggattgacatgaattttacgctgcttttccagaaatggatttgattataagcgttagaattcggctgaaaaattgtgtaaatggacgataaatcggaaaattgttttgatggtacccagtttcggttagcttgtcactggcttgtcaccatcgcgggtttctggctggatgccgggaaaaatgttgggcgcctgcaaagtctgggccagccgccgcgcggctgttacaggttttgcttggggcggcccaccttactgttcgcggtgcagcctgcataaatactgaaacctgtcctgctgttggcggcacagccgattaaagttttttggcttacccttttttcaaaaaaggtaagtttcaaaaaaacgggaaaatcggggatttctatacgtaaggtatttgctttacggggtttttgtcggattttcgttataatgatgggctgcataaacaaaagaattcagccgataacgggtgattgagcgagataatctctctaaagtttttaaaaggtactcagtttcgggtagtggtaccatttaagaaaatacggattgtaaaaagtgatggaaacgcctgatttgcgcacaaaataaaataaggcccaatgctttgaattccgataaaaataaaagaatttgagagataaatcgatatttaaataataaaaggtacccagtttcggatagtggggactgatctgtgggactgttgtctgtaaaggttcggcgcttttcacaatcagacgccgagaagcttttttaaaatatcattgacaagcttgctgtcagtcaccttttgggccacggccgcccgatgcagcgcgtcaatgacggccgcgtcgagataaaatgttttgttctttgcgcttctcccctcgtcgcgcacaatgaatgcggtcaaatcgactgccggcgcggcttttgcgctttttgaacgcgcttttggctgtgcgggaagcggctgcggctcccggctgccgctgtccgccgcaggcggcgacgggtgttccgcttgggctgccgcgccgctgtgcatatcctcaagcggcgtatccgccgctgtgccgccgggcgcaaaggcgcccggcgcggtggaggctggcgcctgccgttccccttccgcctgcccgtccggatgctgccggcgctccttggcctggcgttccaatacgcttttcgtaaacttgtttgccatgagtatgcccccctgaatgcagtttgatacatggcgcgggccattcgtccggcgaatagacgcgcgcataggttttctgttcgctgcctctattataggatatttttttcgaacatttcgtcgacaagcgacgcaatcgcatcgcagcctttggaacgaaggtcgtaaagcgagatcggtatagcggccagttcgctttctgtgatgcgcacgttgcgcgggataatggtctcaaacagcagcgcgcgcaggtcctctacgtcgggcgaggtgcgaagatattcaaggaaatctgttgacagcttgttgcgctggtcgtaatcgttgacaatgaagccgcggatattgtcggcgcggcgcagacggcggcgggcgtcctcccacagcgcgatgaaaagctgcgcgccttcgatggcgttcatggaaacgtcgctgacaagcagcacggcgtccgaggcgagaaatgcgttttgattgacgatcgacatgcttgggttggtgtcgatgaaaatatagtcgtaagtatcaaaaaaatcccggttgtcagccagatagtttgagaggatctgttcgcgtccggcgacggatgctattttcagttccgctttgtgcaggaagatcgatccggcgaccatatcgagctgcggcaggcgttcgatcggctggcgcacgacgagcgcctgcgggtcgggctggtcggtttcgatgttatatatatcgtatgttgtgagaagatccgcgcttgtgcggtcgatgcccatgttgtttgtcagattgccctgcaaatcggaatcgatgacgagcacgcgcttgccaagctgcgacacaatgcccccgatgttaaagcagagcattgttttgccgacgccgcccttgagcgttccaaaggtgatgatttttgccatggcgaaagcctccaatagattcgttattgtataaacgattcaattatttaggacagtataccatacaatcgctgtgatatgcaagcatataatgtcgattgtatgcgtaaatacagtgttttatacaattgaaaatatattaaaatatacattttttattaaataagccattagataacataatatatattaacatataatatttaatagagaaacaaatgcattagttaatataatttatattagaaaaacaattatattgtcgaatagaaaagtgaatatgcttgcgattcaatccgcggatatgataggatataaattaaggagatgatcaatatgcaatgggacgagcgatttctaaacgagctgcgcgcgctgctgcctgaatatatggctcagaagcgtattgtggtcggtacacgcgggaaaaagctgatccactgcatcaatcccgaacaccgcgacaggaccccgagcatgtcgtaccatccccaaagccggcggctgcattgcttcggatgcggggccaactacgacctgtttgacgtgatcgcgatggattacccggactgcgacagtttcccgcgccaggtcaaaaaggcgtgcgagctgttttgcatcccgctgccggacaatgcgcccgcgtcaaagcacggcgtgcgcgccgccgcgcagccggcgcgcctgacggccgattatacggacatggtccgcgcggccgtcgccgagcacggagccggcgggagctatttcacggcgcgcggcatcccgcgcgcgctgtgcgagcggtacagcctttacgaagccggcggacgcgcctggatgcccgttttcctggatgggaaatgcacctgctactgcgcccgcgctaccagtgacaatataacgccgcgctataaaaacagccccggcgccatggatatatttaacgccggttatctgaccggcgagggaaagggcggcgccctgttcattgcagaggcgatccttgacgcgctgtcgattgaggcgtgcggctatcgtgccgtcgcgctgtgcggcgcggcgaacgtggggaaatttctgtcgctgtgcgccgcgcacccggcggccgccgccgggtatacgctggttgcggccggcgatatggacgcggccggcgaacgtatgaaccgctctttaaaggagggactggaggcgctcggcctgtcatgcgcggttttgcagcttccgggcggcgcgaaggacgcaaatgagctgctgctttccgaccgggcggcgcttgcgcgggcgctggcggagtccgccggcgcggagcaggccgcctatgcggccgaaagcgccgcccggtcgcttgaggcgctgctcgacgcatccctgcgccgcgccagccgccgcgcctgcccgacggggtttgcggcgctcgacgatgcgcttgacggcgggctgtatgcggggctgtatattataggagcgatttcatcgctcggcaagacgtcgtttgtccttcagatcgccgattatatcgccgctcatgaaacggatgtgctctttttttctttggagatgagcaaatttgaactgatggcaaagagcttatcgcgcctgacctatcaactcgacgcgccggccggacacatgcgcgcgtttaccgcgcgccaggtgctgcgcgtcgatccggatatgccgcttgaaaaaagcatgctgctcaatgaggcgctgggcgaataccgtaccgccgccgaggggctgtttatctgggaagggctggcggacatcggcgcgcgtgaaattcgtgagcgcgtacaaaagcatattcagatccgcggctgcaagccggtcgttgtaatcgattatttgcagatcctcaagccggacgacccgcgcgcgaccgacaagcagaataccgaccgcgccgttgtcgaactcaagcgcatcagccgcgattttgatctgccggtgctggcgatatcgagctttaaccgcgaaaattaccgcaatgccgtatcgatggaagctttcaaggaaagcggagcggttgaatattcatcggacgtcctgcttgggctgcaactggccggggcaggggaggcgggttttgacgtgaacgcggccaaggcgcgcagcccgcgcgcggttgagcttgtcatgctgaaaaaccgcaatggaattccctatgccaaaattgaatatgcgtatgcggcgcggttttcatattttggcgagggacgcgtgtcgcataagccgtaaaaagccgcagggccggggattttccccggccctgcggcttggcaggcaggttaaacaggtcgttctgattgacagaaattgtcgaatattgtatcatgaatacggcgctgccacagacggcacgccgggccgcggcccggtgatcaaaggccggccgcccgcaggggcggttcccggccaaagacggcggttcaatcgtgcccccaaaagggggtgtgcgtatggagtacttaatcgtattggtaattttgctgatcgtggtggactccgtcctgcacaataaaaaacgataaccgccccaccctcagaaagtgaacggttatcgtgaaactaaacgggggcgaaccgtctgccggcagcgcctctttatgtatattgtagcacgcgcagccgccgccgtcaagcacagggaaaagattgacagaaaatgtcgaatattgtatcatgaatacggcgctgccacagacggcacgccgggccgcggcccggtggtcggaggccggccgcccgcaggggcggttcttgggccaaagacggcggttcaatcgtgcccccaaaagggggtgtgcgcatggagtacttaatcatgctggtagtaatcctgttggttctggattccatcttccgcaataaaaaacgatgaccgccccatcctccccttaggataacggtcatcgttttctctttaagcgggggcgaaccgtctgccggcagcgcctctttatgtatattgtagcacgcgccgccgccgccgtcaagcataaggaaaagattgacggaaattgccgaatattgtatcatgaatacggcgctgccacaggcggcaggcggttaagccgctcccttgagatatgtatggtggaattgttgttgcgattttattagtcgtggcgattacagaagccgtaaaatacataaaaaagtaaccgccctcacaaccaaatgaagcggttacttttccactgaatttgggcgaaccgtctgccggcagcgcctctttaaaataattatagtatacgccgccgcggctgtcaagcgcggcggttatatatttaaataggtagtgcacgggattgcagcggaatactacaaaatgtaaaaacagatggtgttatgacaaaatgttcttaaagtattaaaagtttattcataaaaaacggggaaatacggggtaataggttggaaaacaggctttgaagtggtaattatgaagaaaaagttacaaagtggtaacaatattgcttgacatttccaatgcttgtgttatactaaagccacaaggaaatggctggagagtgtttcctgtacttaaccatgaatttattcaaggaggagatttaccgatgaaaaagcttctggcggctgctcttgcggtcgcgactgttgcttctttgagcacggtttctttcgctgctacagagtgggaggttaccgattatgatcagacggtagcgatctttgacgacggtacggttgccgcttatgatggcgccaacagcgtcaagccggacaagacgttgtattttgcgattggcgatcttgtttataataatgcgggtgaaacctggactctcagcaaagaatactttaccgataaggactacttcaaggttaagactgacaagggcgacgaaaacgtcaagatgatcaagtcgatggctctgtccgagaagaacatcaacggcaaccgtggtccttggttcgagatcaagctcaatgacgattacaccgacaatgagtacaagatcaatccggaattcaccttgactgtaaaagaggatttctatctgccggccggcggaaacactctgcgtccgaacgacgatgattccatgggcgctggcgatgtgatcaaggttgccaagggcgataagatccactatgcagtcggcaagtactacatcggcaacaccaccgacgacgctgaccaggattatatggccggcgacggcggcatcgtgctcaagcccaccaagaacgatgacaacgagatcacttgggaagatgagaacaacacgatcgctacgctgaagttctacagcgacgacgacgctgcgaagttcttcccgaagctgaccacaaagtgggacaacactgattatgccgagtatttcgcagatcagaacgcgttcatctttgatttcgtcggccgtgcagccggtcagaccaagatcgcttccaccagccgcgctacgctcgaactctacaatccgtactatgattgggatgaggacatgctgacggttgctccggaagactgcgtcatctatcagatcgttgacggcgagctggtcgatgtgaccgcttccttcaccgctctgcagaacgatgacggcgactatgttttccagaccaagacccgtgagctgggttgctacatcatcgctgaggcgcaggctgccgctgttgttgaccccggcacgaccgctccgaccgatgagaagccggtcccgaacactggccgctaattattgttaacatctaacatttttggttctgttaaagggacaggcgactctccacgcctgtccctttttttggccgttcacaataaaaagcaggcttgcttgttaagcggcctgcttccatgctggaatacagatagagaggcgctgtcaggaagacagtgcaccccgtttaatggtaaacgataaccgcctatgccgcaagggttagggcggttatcgtttttgggaaagccggaggcacttgacagaggccgagcgccatgctacaatatacacaaagaggcgctgccggcagacggtacgcccccattttagcttaacgataaccgttaaccttggtggaggttggggcggttatcgttttttattgtgcaggacggagtccaccacgatcagcaaaattaccaatacgattaagtactccatgggcacacccccttttgggggtacgattataccgccatcttcggcctgaaagccgcccatgtgggcggctggcctccgatcgccgggccgcggcccggcgtgccgtctgtgacaacgccggttatattgtacaggattcgacaaaatttgtcaaataatgtttgaaagtaaatataatgatacaaaaaccaacaagctgtagtagtttctggacttgagtatacaacagcttgtgtacataaaaaattaataatatattaataaaatagaaataaatacttgaaaaaagaattaaaaaatgacaaatctattacaatcatgccgcaaaaagttacaaaacggttacaaaaatgcttgacattgtcatttttagacgctataattggaaacagttaagggaatggttggagggccgcctttagccaggatcatttaaaactgatttttcaaggagggaataaaccattatgaatgcgaaaaagcttttaagtgcaatgcttgctggagcgacggtcatttcgattgcgtctgtatccgtttttgcgggcaatgtggcgatgggtacagcttataacagcgacggtgaggcgtcggaagatattgtcggatttacatccagcatcagcgggctcacgctgaactcccaggccaatatcggcgctgatcccgtttatccaggctcaacggtctatattccgctcgcaactgaaatgaacgagaagtttggatcttccgctgtttttgtagaggatgtcgtgaatgaggactatttcaagttcgacgttgataaagatgtcaatgccaagcttgtgaagtctgtcacgattgttgacgacaaaaaactgtccgataccttgagccgttccgcgtatctcaagattgagtttgcggatacaacttcaacagatgaaagtaaaacgaccggcgatatcacctttaaggcgaaggcggattttgattcttatgcaaaaaagaacgatcagccggttacaaccggaagcaatgtctggcagaaggatgacaggttcaccattcattacaatttctgggtcagcaaccgtgaagttggcaacgatgacaacccggatacaggcgatggcattgtgatgaatccggatgacaatgacacgaatattcttgtctggggcgacgaccgtgcggcccttgagtttgagtccgacgacgacgcttccaagttctatgcgaagatgtccacaaagtctatcgctgacatctatactgaatacggcgatcctgccgacgcggatctgtggttctatgactttgtcggcagttcggccattccgtcaacctcccgcgcttggctgacgcttggcatcccgtgggacgacaatgacgattatacgccggaccccacatcctgctatatttatgagcttgacgccgacgggaatctgacggatgtgacgagcagcttctcctacagtgaggacgagcgtgaaatccccggatggtcgcgccagacgcggacgcttggcacctatatcgtttcggacacagagcttgacatcgctcccgttgacgatacgacaacagatgagcctgctcccgagccggagacccccgccacaactccggaaaaaccgatcccgaacaccggccgctgattttgcgccggatttgacagggaaagagacgcacaacagagaaaaagagatcatgccgccggctgcctccacagccggcggcaattttataaaagcacgcttgccgccggaatgaaaaacgacgaaaataaccgcagcgcagcagttttattaatcataaaaagccggtaagcttaccggctttttatgcggcaaccggtcaaaaccgtgacgcccagaacacatgcgctttcctttggatatgaaaaagcctggagcacacattgactccaggctcttgtctgatggagcaggtgacgggaatcgaacccgcgttgtctgcttgggaagcagaagtgttgccattgcaccacacctgcaagatgtttattattataccggattatgggcggaaagtcaagcccttcccggacatgacgcaggtatgggcatattttaaaaaagtatataaaatgcaaatattttaagtgattgttcgaaaaatcttgtcttttgtcattatgccatgtatactactattatagttcaaaacgctggcgggccagcgaatggggtagacctaaatacagaaacaggagtgattggcttgacggcattgctcgaacaggtgcgcgattatcttgatgcacaggaatggaattatgatattcgcggccaggaagacgatgaatatatgatcatgcgcatgaatttaaaaacagttgatgcgtgtaccacggtcatgcgttcgtttgacgaggattcctttgttgtttacagtatttttccgattaaagtcccggaagataaacgccctgaaatcgcggagttcatcacacgcgctaattatggactcaatcacggcaattttgagatggactttgacgatggcgaaatccgttacaaaacaacggccatttggggtgatctggaagtaccggaacgccatatggaccgggtaatcaatcttggattttgtatgctggaccgctatggttcgggtatcttgtccgtactgtatggcggcgcagacgcagcggctgcgattgataaaattgaaaacagtgacgactagggctttataaccgcgctataaaaacaggccgcgccgcgaacagcggcgcggcctgttttaagtgggtgctggcaaaatccatgccagccgcgcggcgtctgtcacggattttgctggcggaagcagggcgcgcgtgacccgtgcgcgggccgctcaccgccggacgctgcgcttgcccggccggctttggcgcgcgctcccgggttcgcttcggttctttccttctcgttgttcatttttcaaggtgctgcgcgctgtcgtttgatcggcgtttgtgtcgttcgcacgaggcagcttttgtataataccacacacgttattttttgtcaacacttttttcaaacttttttccgaaaaatttcctcggcttgatttcgcccctttaatgggatatcatgaagttatcagagaacaaatgaaggtgatggaatatgccgatcaaaatccccgacagcctgccggcctcgcgtatcttagagcaggaaaacatctttgtaatgaccgagcatcgggcgttgcatcaggatattcgcccgctaaaaattgcgattctcaatctgatgcccaagaaaattgaaacggaaacgcagctgttgcgcctgcttggcaactctcccatacaggtggacatcgaattggtacaggtcaaatcgcatacttctaaaaacacgccgtccgagcatctttttaaattttataaaacattcgacgatatccgcgaccagcgttttgacggtctgattatcacaggcgcgccggtcgagcagatggcctttgagcaggttgagtattgggacgaactttgcggcatcatggagtggagcaaaacaaacgtcttttccacccttcacatatgttggggcgcgcaggccgccttgtactaccattatgggattcacaaatatcctctcgatgagaagctgttcggtattttccagcaccggctggtcgttgagaatcatccgatcacccgcggattcgacgaactgttctttgtcccccactcgcggcacaccaccgtttcccggcgtgagattgagcggtgccctgagcttgaaattcttgcggtttcaaaagaagcgggcgtctacatggctggacggcgcgacgggcggcagtttttcatcaccggccatgcggaatatgaccgcggcacgcttgcagccgaatatttccgcgatctgcaaaagggccttgcgatacacatcccggagcactatttccccaacaacgatccggcgcagacgccgccgcatatctggcgcggccatgcgaacctattgtactgcaactggctcaactattatgtttatcagaccacgccgtacgagtttacggaaggagtggatgaaccgtcctaagcaggagcgcggacccggtccaaaaagatcgggtccgcgctcctgttataaagcctttctgccgagatatacaagctgtgtacaccgctgtataccggtctgagcgcagcgcgtctggatggatttcgcctcgctcaaaagcatctcgtattcgggccttccgcacgcgtgcttttccacggcgcggacgagcttttcatttttctccgccagctttgcgtccattttaggatcctccaaaagctcgacggttttcacatcggtcagcggcagccggctgagaatttttataatttcatctttccgccaggtggggcgctgaaatccgccggagagcatatccagcttcgcttcgaagcaatgctgcaaaaaatgcgtctgctgcgcctcgttctgcccgtcggaaaacatctcgttgaccaaaaatacgccgccgggacgcagaacccgcaacatttcgtccagcacagcgttatagtcctcaatatgatgcagggtattggagattgccgccagttcaaatgtattgtccgaaaaatccatatggtcgccgtccccaaggacaaactccacatcttttcctgcgtttttctccctcgcctcctccaccgtttttttatcgcaatccagaccgatgacgcgcgatcccgccggcatggcctccgccagcgtaaacgcgaactccccataacgcgtccccacgtccaaagccatccccggtcttaggccgggcaggtattctttcaaatgcagcattgccgatcttcctttcacaccgtaaaagcccgtttaaaatcccggcgcggattttaaacaggcgtccaaggccgcctccgctcgccggaggcggcctttttaattttgtagaatcaattttatttaagcgtctaccaacacaattcccaggcgttttgcggccgcctgcgcttccggcagggacggatcggcgccgcgcagaacaagccgcccgccgccgcgattgagcgtatccaccatatagctgctctgatctgtggtgatggtgattttctgaatggcgtgctctgttccctcaacaatctccacctcaatgcccgcgtccttaaccatctggaccgacttgttatacatctcgtaatccgaggtggacgcgccgaacacggcgcccatcagaacgccggggatattgatggagcggcgcgcaaacaattcaggatacagttcaacacgcacctttttaatcttgcccttgacaagctcatgacagatgcgcgcagcattcgtcgggctgcccacagcctggctgctgccgccgacaacggcgtctcccagggtatgcaggatattttccgtgccctgcgccagttttttggcccttgctttggctttggcaagcgtctcctcaatctttttagcctcagcatccttaacctgctgacttaccagggactccacagcgggcttgcgcttaaagaacggctccatatactccacaacgatgggcacaagggaatgcccggactcgatatgaacctcggccgccatagccagcatgacgtcaaacggcacattgaccgtcatatccaccttcatgcacaaacgtcccgcatacatccccatcaggatcgctccgcccacatgcgtggtacacagcgcgggcaccagaacgcgcggcgtgcagggtacgccgatggtaggcgacagcgccagcaccatggccttttccatctgttcaggcgtgccgccgccgatggagacggtcgccgcggcgatacaggcggagcctgcgccgtaaccctccatgttgcagccggttgtaaccttgcctacccggaagatgctgccgatcttgatcatcagcgcggctgtctccgcgatggttttctcgtcgtaaccatgcatcatcatcgctttgataaagccggaatacggacaggagtcgcctgtaccggcgcaggggcgcaggccgatacagtggttgcccacctgtgcgcccagcgtatacaggagggcgtcatccaaaaaggggtccgagaagcacttgggaccctcctgcgcggcaagctgcgaggctaccgtaccaagcaggatgctctcgccgtccttgacgccgatttccacagccttaaggttgtgggcgtattcgttcataatgccggtgagaatctcctcacgggaaaggcccgtgcgcagctctgtctcaataagaaccacatctgtcacgcgggcgccgaactgcttggcgacgtcgatcatctcgctgacggtaagcggcagtttctcctgaatcacagctctgatatcgctcattggatatccctcctttttgctcctgtacggatcacttgaccacgcggccagtggcataattggcttcgatttcgcggatttcgggcaggcccacaatctcattgaactgagcgaagggaatcattgtgtcaatcagcgtttcagtcgtgtcgtcgcggcgcatcccctcccagagatccaccatggctttggtggtcacatagacggaggcggtcggatagataatcaggttatagccaaattcggaaagctgcgcgtttttaaacatgggcgtgcggccgccttccaccatattggccagcgtcaggacacccggaagctcctcgttgatacggcgcatttcagcctcggattcaggcgactcaacaaagataatatccgcgccagcttccttgtaggcatgcgcgcgctccatggccgcgtcgatgccgtgcacggtgcgcgcgtcggtgcgggccataatcatgaagttgggatcgatgcgcgcgtccacagcggcgtgaatcttgccgaccatctcctccatagggataacctcgcggccgatcatatggccgcacttcttgggcatcacctgatcctcaagctggatcacagccacgcccgccttttcatactcgcgaacggtgcgcatgacattgacggcgtttccaaatccggtgtccgcgtccgcgatcaccggcacgccgcagcattccaccaggttggccgcacgggcgaccatctcgctcatcgtcataagccccacgtcgggcttacccagatggctggctgactggccgtaaccggtcatgtacacggcgtcaaagccgagctttccgatgatcttgcctgtgagcatgtcgtgcgcgccgggggcgaccactgtttttttgctggcaaaaagttcgcgcatcttcttaggtccgttcatattccaatcactccattttttcatatgttgggcggccggcagacacatcgggaccgaaataaaccacatgtccgcctgcgactttgccggcccgcccgaattcatccggggcgtttcatgccccgccgcactaggggctgtttgaaaaatcggaaataccgtctttttctacaaacagcggtgaatccagcgttaaaaagcctcggaatccgaaaggattcctgggttttttgccttgtattctcctgctgtctgcgaaaaatccggcaattcccctattttcaaataagccctaacttcccgtatattccttgagaaaactgaacgcggcatctggatagtatttgccgagcacgcccatggcgtacagaatatagtcgcggtcctgcacaatctgcggcttctcctgcggcagcagagagatacccggatcttcaaagcagcgcagcaccatttcctcggccgcctgtttgtccgaatgaacgaagatgccgcccacgcacaatacgcgctccacacggcgcagatcgcgtccaatggcagtgcccgccataatccccatgaccgggtcagccgcgtcggcataatggcccgcatggcggcgcagggccgtgttgatggcgcaggtggccatcgcgcgttccagggatttttcccgctcgtcggctgggatgtaatcggggtggtcctccagatgctgggcaaagcggagcacctcgtcgggcgtgacgccgtaatcgccgtccatagccctgatcaccgcattgggaccgacagcctccgggatgccggtcgccgacacgcgcagccccagattcccctccacggtgcggtaggaaaactgcttttcattgttgatgatcagtccgcgctcctcgatggagagcttctcaagctccggcagggcggagtggatatccgtggtcgcgccgccgatatccaccaggatcagcgagccggcgccctcctgctcataggtgcccttggccagcagctcgctggccagaagcaccgcgccgggtgtcggcaccacagcctgatcggacaggccggcgcggaattccaccaggcccctggctctggtaatctgcctgataaactgttcgtggatggcctcgcgggccggcttgatattcagctcgtgaatcgtcggcataatgtttggtacgcgcacatagccgacgcccgctttgtcaaaaagctccgccacagcgcgctgcgcatacttgttgcacgccacgatcaccgttgctttgccgtgcagctcgcagatcatctccgcgttttccagggcgcatccctcgtccccgccgtctgtcccgccggaaagcaggatgatgtcgggattgatctccatcagcacctctctgcggaaagacagcggctcctcggcggaaaccacctgcatcacccgcgcgccggccgtcatggccacctccttggcggccttggcagtgacgcgcggcatatatccgagagcgaccatacgcagccccccggcggcggaacaggagctgtaccgtttcatctccgcagcaaattgcacgccctgggcttggatagccgcctcggctctgcgcgcgccttccataacgtcgtgcagcgtggtgggcgactggccgcgccccaggaaagtaaagcgcctgtccttcagcgcgaaggccgccgccttggtataggtgcttcccacatcataaacaaggatatcagcctgcatttcaaccgcttccatcagggctgtttcccgtagattttagaggtctccacatagacatacccttccataatacggcgggccgtgcgctcgaaagcggctttttcgacgtggccgtccttcacgtccgccaccacgggcagcacaccggcgggatggccgatacggattcgggtcttgcgctcaatatcagggatgacctggttgacgatggtgcccgggatcttggcggccgcgccggtgcaggcggtggcggtgcccgcgtatgtcttgtgaagcacctgcatgaacatcagcctggccacgaaatccacctcgtcggctttgatcgtgtttccggtcgtaaagtccgtgtaatccgccggggccgtgacaaagcagatcatcgggaaagcgggcgacttggtgcgggcctcctcctcggttttacacttgcccatcatcacggcgcccttggcgcgcagctcctccagaagctccagcagcgccttgttgccgttgatctcgctgggcgtctcggtgcctttcatcccaacgtcgcttgcgcgcacaaagatgcagggattagccacgtcgaccattgatgcttcaatcgcgcctttgctcgtctcaatcacatccaccacgttcccggtggggagcagtttgcccgtggccgcgcccgcggtggaggcgaaatccatcagaataggggcgcttgtgccggggacgccgtcgattttgcagtttccggagacaacggccttcccgtcgcgcacctccacctcggcgcgcaggattttgcctgtgttggtgttgtggatgcgcaccatggtaacgccctcctcggcgcggaccatgctttcatcaatggcaaaggggccgacgccggatgaaatattgccgcagttgccgctgtaatcaatgaccgtaccgtcgatgctcacctgtccgaaggtgtagtccacgtcggcgtcgtcgcgggtggaagggccaatgatggccagcttgctcgtcagcgggtccgcgccggccagcccgtcgatctggcggacatcggggctgccgaagatggcaaggatggttttatcacgcagggcctggtccttgggaagatcgttttccttgataaaaatacctttgctggtgcccgcgcgcataatcacgcagggaatccgcatctgatcgctcatatctgacattcctccattcatctatttttctttttttcttcaatcgctttggtaatgcagtcaacgcacgcctgaggatcggagcctgggccgaaaaatgcgtccacgcccaaaaagcctacgccctcggactggattttgtcctcgtaatacttgtgttcttcttccttctcagcgatacgtccgccggcccacacgaccattttgtcccgcaggccaagctccttgagccgcttctcgacgcgcgggaacagcgtgacgcccaatcccagcaggttgctgacgcccaccgcgtcggcgtttgcctcggcggcgacctcggccaccgtctccggcaggttcatgccgcgcaggaacacaacatcatatcccgcgtcctggaaggcttcgcggaccacattgatgccgttgacgtgcgcgtccgccccaacggtcgccagcacgatcttctccttgcgcgtcggcggcttctcgatatgtaccgtgacatgctccttggtgataggacagcgggacgcgtcgacgccaagaggcgtataccctttgacatagcgggtgatcccgtccggatcgcggttcgtcttaacatagcgtttgaggtcccatccgccggcgcggggggtgtccatcatgccgctcttgccgccttcgacgatcaggtcgatcagttccgtatcgctccactgatgccagaattcctccgtaagacagccgggcttcaagctgcgggacggcagatggaggacagcctccagaacggcaaacgcctcgtccatcatcatggattcatactcgtcgatgaccggcgattcgacgccgggattataggtgcggcggaacacgtcctcggacgcccaaaccgcctgccccatggagtcgccggtggggattcccacggactcagcagccttgggacggtagaagttcgcgccgccgagcttcgcggagatcgccatgcgggcaaaatgcgcctgctccgcgatcaggttggccggcgggttctggaatgtctcaggaacgacgatcaggctcttggagagcatattgtggcggaaggcgcgcataatggccaggtcgcggtagaggttgttgccgcccacgttcatctggatgccgctcagttcccagggcagaccgccgtgcgccgccaggccctcggccagcaggcacatcgcgatggccatgccgtccgtgccgccgatgttgttgatatgcttatgtgtgtcaagctgcgcgaatatcttgttttcgccgcagatctgaatcgctttgtagccgttgacaaccttggtgcggaaatcatggatgccgcggccgccgaaatgcacatggatgacagggccgatgtccgtgccgtcaaagccggcgatcagggcgtttaagatgttgatatgcgccgtatcgccggtggcgttgatacgaacgggatgcttggcgccgccgcccatctggatgaattcgcgctcacccttcggcgtgatgccgcccttgcccctggactgctcaatcagctcgcgccccttgagcgggtcgatgtggcgggtggcctcggagtggacgaactggaagatggtgtcgttatacatatccgcatatttgtagatatcacacgattccttccaggtttcctcagccgagttgcgccccaggatcggattcaggcacgggacgcccgtctccagcgccttctggccaagctcatagatgcggtagccgctgcggacaacgcccgccacctcgcgcggatacggtccgggcagccccacgacctcgccgttctcgtccagatccggcatctccacgccgaagcagtcggcgtaggcccggatggtttcaatatcttcctttatgattcgctttgttttttcctgtggatctttcatatatatcccccttatcgctttcggatgcggccggtgcttcccggccctttcccattgttaagcaagcccaagttcggcgcggacgcgggggatcagcccgccgtattccagcgtcttcaatacgttcgcggccagcggcgcaaactgctttacttctccgtttaccttgacggtccctttctccaggtccgcctctatgatatccccggtgtgaaggctgtcagctacgtcagccgcccagaccggcaggccgatattgatggaattgcggcggaaaatgcgcgcaaagccctttgctatgaccagcgacacgcccacctgcctgagcgcgataggcgcctgctcgcgggaggagccgcagccgaagttgcgccccgccacaaggatgctgcccggctcaaagaccgatttaaaatccagacctgccagaccagccatggcgaattttccaagctgatccatcggctcggccatcgcatagccgggaagaatctggtcggtatccacgtcgtcccccaaaacgattacttttcctttgatgatatccatagtcagccctccgcctttggtacggtgatcctgccggcgagcgcggttgccgccgccgttgcaggagaggccagataaatattggccttcatactccccatgcgtccagggaagttccggtttgtggtggaaaccaccacgtcgcgctcgcttgtaagcccctcgtgcgcgccaaaacagggaccgcagccgggattgagcaccgtagcgcccgcgtcgcggatgattttacaccagccgcgcgcctccatctcctccaggacgtccctggaggcaggaacgatcagcgtattcacatcaggatggacgtgttttccctcaaaagccttcgccacctgctccatatcgttgatacgtccgttggtgcatgaacccactaccacctgggtaactttgacgccttccacctcccggaccggaaccacattggccggcgagaagggcttggcgatctgcggctccagcgcggacagatcgacctctcgcgtctcggcggtatcgccttcccgcgcggttgtaccaaacagggtaatcatgctgccgatttcaattcccatattgcagacagtcattcgttcggccacggaaaattcctcgataccaggtccggtgaacaaaagcgccttgtccaccagataatccgtgccaaacacactgcccaggtaaaggattaaatccttgccgaatacgttggccggccgctttccgttcagatagatctgaacgacttccggcacctccagatcaagcctgccggtcgccatagccgcggcaagctctgtggaaccgacgccgataccgatggcgccgtatccgccgcaggttccggtatgggaatcggcgatagcaatcagctcgccgggcgccgcgcggtgcttttcatacatcagctgatggataacgccctcgccgcgctggtaaagatgcacgccgaattccttggcaaaatcgtccatggcccaaacgctgttgcgggccttttccgtcgcagccggatagatatgatccacaatgagaaccacacgatccggatcaaacaccttgctgacgccgatttcacggaacatcttaatcgcgattggagcggtcacatcgtgggcggccacatagctgaccttgcaggaaagatcgtcccccgcgtgcgcttcggcaacaccggcagccttcgccagatatgtttcgatgatattcatagagtctccattcactccgtttcataggattttgccgggctgtgagcctatccccaagcccactttgcgcgagcttggagacaggctctctcaaacaggccgggacaatcaggtcattctgattatcctggcctgcccgtcccggtgcggaccagaccggaaggcccgcctgttccggcgcttcgccatagaaaagcgcgcaaaggcggaattttccaacaggccctcgggccgcgaaaggcgggggatgcccgtggacatcccctgcctttgcgttatttcttgtacagttcgcgcatgatgtcgagatgctggatgggaagcttgccaaagcggatgttcagggcgttctccacagcatcggcggtggctggaattgttgggatcagcgccggttcgccgacgccctttgcaccgaagggccccgttttgctgctgccgctttccacaacaatgggataaatggtcggcgcgtccatcgcggtagccagcagatatttcgagaaaacagggtttgtgatacggccatccttcgtctcgatcttctccatcagggcaaatcccgtacccatgaccacgccgccctcaacctgaccttcaacggcctgcctgttcacggcggttcccacgtcgtgcgcggaaacaacgttgagcacatccaccagtccggtttccacgtcgacctccaggtccacaatggtagcggcataggaatagacctcaaacggcacgccgaacatatcctcggcgttgagtcccgtggtcctggggttatacgccccggagccgagcgccagcttgccaaggcgtttcatctcgcccatcagctccggataagtcatcttgacgcttctgtcctcggaggaatagatttccctgtgacggaaaacaagtttatcctgcggcacattgagataatttgaagccacctcggccagtgtatttttggccatgcgggcggccagcatggtggcggaaccggatataaaggtctgacggcttgcggaagtcgccccaccctccggagtgacctcagtgtttgcaaaggtcacgtggatgtcctcatattccagtcccagttcctcggcggcgatctgcgccatggcggaggtggaaccctggccgatatcggcgcatccgaccatcaggttgacgctgttgtcgggcagcacctcgacaaacgcgccggccgggttcggaaggccggtgttgccgatgccgtaatacatgcagccgtagccgcggccgcggcgtttgttgggcgctgttgggacgcagggcggcagaacctgactggccttgtcgcgcaccgcctcaagacactgcacaaagccgacgttttcatcaagcacctggccggtggaggtaacgctgcccggacggtgcgcgttgataatgcgcagctcaataggatccatgttaagcgccttggccaacgcgttcatctgtccttcgtgggctacggccacctggggaacgccaaacccgcggaaggcgcccgccatggggttatttgtgtaatagaaggtcgcgtccacgcggacgttcggcacctcataagggccggcggcatggacgacagcgcgcgtgataacggcgggtccataggaggcgtaagcgcccgtatcggccagcaaggtcgcctgaacagccagcaccttgccgtccttggtcgcgccggttttatagtgcatcttgaacgggtgccgcttggaggaaaccatggtcgattccatgcgtccgcggacaatcttaacagggcgcttggtataataggaaagcagcgccgcatggcactggacggagatatccagctttccgccgaaaccgccgcctgtggtaacctggacggaagacacgcggttttgaggaaacgccagcattccggcgatttctccgcggtcataatgcgggttttgcgtggagctgtaaacgatcatctgtccgttttcaaagctggcgacgccggcgtcaggctcaatgaacatatgggacagcatgggcgtctcataatcgttttctatgatcacatcgcagtgtttgaaggcttcgtccacatcgccgtgctcaagatgctttttctgatggacgtttgtttcaccgtgcaccttgggcgcgtcctcctcggcggcgcgctccatggtgagaatcggctcgtattcctcatactccaccttgatggcctccaaggcgtcgcggacaagctccggcgtttcggcggccaccacagcgatggcgtcgccataccggcggattttgtcatccacaaggatcggctcgtccttgaggatgatgccaatcctgttcttgccggggatgtccttgcttgtcagcacacacaccacgcctgggatttccagagcggcggacgggtcaaagttcttgacagcgccatggcagatggtgctgcggaaaacgccgccgtagagcatgttcggcaactccatatcggccgcaaacttggcgctgcccataatcttctccatggtgtcctttttgacaacgcttttgcccaggatggaccagtcgtgctgaccggcgacggagacatccacagagcttttttccttgacagcgacttctgtttttttcattctctgacgcctcccttcgcatcgcgggccatctccacggccttgatgatcttgctgtatccggtgcagcggcagaggttgccggacatggcgcggcggatttcctcgtccgttgcgtcgggctttttatcaagcagcgccttggccgaaaggaccatgccgggcgtgcagtagccgcactgcacggcgcccgcgtccacaaacgcctgctggatatagttgagctggccgttttctgaaacgccttccagtgtcacaatcgtagaaccgtccgcctgtccggccagcatcaggcaggatgtgacggccttgccgttgtaaatgatggtgcaggccccgcattcgccctcgccgcagccctccttgacgctggtcatgcccatatcctcacgcaaaaagtccaccaggcgcttgttggggtcggcggtgacagagacgtcattaccgttcaggttgaattgaatcttgatctgttccatattggttcttttcctccctcacgccagaccgaactgactgatgatctgatcgaagcagcggcgggccgctccgcggacgccttcgcgcttatagacgacggaaggccgtgttgggatcgccgcctggacggcgtctgtaaaagcgggcagcgtatcgtccagagattgcctggtgagcgcgcggcccttcaaaagtgcttccagctcaggggaacgcatgggatgcttgcttaccgcgcccagcaccacacggcaatcctccaccttgttgtcaggggtgcgttttatatagatggcaacagccagtacaacgatcgccaggctcttgcgcttgccaatcttgaaatatcctacggcctcgtcgccggaaagcgcgggaaaccggatctccgtgagcagctcgtcaggacggatagcgcagttgccgggacccttgttgaaatcctcaatcgtcatgacgcgctcgcccccggcgcttttaagaaccacctgcgcgccataggtgaggaaggtggtggggctgtcgcccgctacggatgcattgacaacgttgccgccgacggtaccgagattgcgtatctgcggtgaaccgacatgaacggccgtctcccaaagagccggcagatgttcctgcacataggcgtcgttttccagatcgtcgaacgtggtgagggcgccgattttcacaaggccctcctcctcttttatgtagcgcagctcggacaatttatcaattgcgatcacatgcgcgggcgtcttatggcgctcgtttagctcaatgatcacgtcggtgccgcccgcaaccacggcgcagctggactgatactgttccagcatggccacggcctcgtccactgtggtgggggcgtggtaagtaaagggcttcatttgtttaaactcctttcgtcctgataggctgtacagggcttatttaccgctcccgcgcactttggcgccggtcaaatcctcccagaccttgacgacggaggacatatcctcgcggccctgccccttggcgcgggccatctcatagacctgggcggcagcggcggtcatgggcagaggcacacgctcgtcgcgcgacgcctcaagcgccagtcccaaatccttatactgcaaatccacggcaaagccgcctgtaaactgatcggccatgatgaatttctccagcttggcgtcaagcgcatagctgcgtcccgaagaaacggaaatgacttccttcattgtctccacggacagtccgcattttacgcccagagtcagcgcctcgcttaaagcggccatattgcatccaagcagaagattattgaccatcttgatggcgtcgccgccgccgacctcgcccacgtgatagatgttcttgcccaaaacatcaaaaacaggcttcaccttttcaaaggtcgcgccgtcggcccccaccataatggtaagcgtgcctgcggccgctccggatacaccgccggaaaccggagcgtcgatatatccgatccccttctcggcagcctttttcgccatcgctttcgtgctgttgggtgctacggaactcatatcgataatgatggttcctgctttacagttttcaaatacaccgccttcggagcacatcacattctccacaatcttggcattgggcaaagagcagatgataacgtccgccttgcctgccagttcgcccgctgtggcgcagcccttggcgcctttgccctccatctccttgacggcggcttccaccacatcgaaggcatatacctcatatccagcgtttaacaggttgcaggccatgggcttgcccatcgcgccaagtcccacgaatccgatcttcataaaatctacacacctttactacattaattgtcagatcgggccgttgggaataaaggccgccctgggtctgtttacaaacaaaacgccacaaaaaacaaagacgatttttcagcgtatcaaacaaaaaatacgggcgagccttttcagccggcgagtctttttgtgaaagcttccaaaaaataatgcggcagggtttttcaaggcgtcattttgtcaaccggcccgtctcagacctccattctcaacggcccgcacaccgcgggtcattgccgcttaggaaaaggggcctccggccagcgcatcgaaacgttcggtcggaggccctttacggttctattagtgcataccgtcctcgcacttggcttcggatttctgcaaaccgccaatgcggccggcgccgttcacagtcgcatgaggacggccgccgtcggacagtacaacagccatgataatttcatcggccttcggagcgtcggggacgcggacctcgaaggagccatagtgcgtgcgcacaaaagcggcgtccttgtaatgcagggaaatatcgagcgaggcgccgacaccggccaccttctcattggaggggatgatggatttgccgccgccgatggccgcgcggatgggcttgccggcctttggatgcagcatcgcagaggaatgctccagctcgccgtctgtgccgacaaggcagcccttgccgtaggtttccacagcgtcggcgcccagcagttccgcgcccttgcgcgccagcagatcgccgagatactcgccgtattcggtcagctcgcttagatcctcctgccatttgccggcatacggatttttgatgacagccgcgacggaaacagtcttgatcgacttcttgccgccgttctcgatgggcatatcagcgccgccctcgtagaacacttcttccagatttgtcacgatcttgcgaatcttcggctctttcacaatgaaacactccttcggtaaagttttataatttcaggattcttccagtatccgattgggatcaaacacagccgtgcgcccctgtacagtagcgatacaggcaaggagattccctttgccgaattgaagctttgcttccttcatcacctggtcaagggcctgctccttttccgcctcggtcaaggggtctacacccaccacgacctgctggtctgcgatgtcgctgtcgctgtcaagctcccccgccaaaactgtatgaacggccggcaggtcgagacaggaacgatccgccaacagagtcgccagcgcgtccgcctcggcgcagcgtgccgaaaataccgtcacgccgctggcaatcccggtcgtcaggcttcggccgcccaagccgctggtcgccacgccgcccacgccgctgcggtttgtcaggcaaaccgtcctggaaactgttcccgccgccagatcgtagacgacgcccagctttaaattctgcccgtcggccagacggacggcgatatctccgccgttattggcgacggccttttccgcgccatgagctgccagatggtcggccaccgcgtcggaaaccgatccggccaccgccgccatgggcgtcaaaagctggtcgcctgtagcgacgaccgcccgggccatgaccgcaggcagaccgcagagcgcatcaggatcaacgctttcaggataactgcgcagtacctccagcacggggcgcatttgtttgagacagccgtcgatgatttcaaaggcgctgcggcacaagtccgtatccccaaccccgccccgcatggcggaaaccaccatggaaacggggccataatcaaagaacacatgcccgggtgcgagcacctccatgacctcgtccttcatacggcttatacgcccagctccctgcgcagctcctccacaggacggatgcagtccatatggccgccgatcgcctcataatcggcctttgtcatggtgtattccacaggggccactgtggccggcgtaggcacccaggtaaagccgtggttgacgaccttgcccgcatcgacaataaagttgataccgccgccgggcaggatataagcaggcgcgccgccgatggtgaggaccgccttgccctcgtgaacggccttggtgatggccagcggctttgtgcacacgccgccgcgggcgctgccgcccgtgccgccggtatacatgacgctggcaagggactcctcgcagttgttcataatgtcatcggccaaggcggcggccttctctgtcatcgggatttccttcacatcgccgtccgggaggacttcgaacagggcgcggatttcgccggtcgtgttgaccaccaggatttgcatcccggccctggcgcgggtcatatccacgctcttgattgcgtcgcgcggcgtttcgatcgtggtgccgccaatcccctctccatgctcgccgaaatagcggccgcgggaggatttgcgggcgttcggtattacgccggaccactccataccgacgtccgcgccggccagatgctcagtgaaaagcccggtgacatgatggtcgatgacgatgacctcgtccaccgcctccttcatcttcttagcgaacagccccacggtggcgctgccgcagccgatgcgcatttttgcttccttcacgccgttaatgacagggggcttgccggcctgaacaacgatttttgttttcttgttgacggaaagctccacttcctcgccattggccagctccacgatggtacgtgccacgatgaagccgtccggcccggtgagcttatttgcgccgcccacggcgatcatcttcgagccgtattcctcggtgttcaccatgccgaccaccttcccgtcacgataaacgggatcgccttcctcgccgatgtaggtgttggtgtccagctttacggtgacgccggaataactcagaggcgcctcggtcacggttgtgaccacctccacgccgtcccggacttcggaaacgatatgcggcgcagggcggatgcagggatagttggtgccggcgcccacggcagtgatgatcgggccttggagccgggggtccggatatgtaataccgtcgttatgtaccaccagcgcgcggttgcgcaccagcttgccgttttcatttgtgtaccgcttgcaggcgccggtgtgccccgcagggatgcggcactgcaccgaacaagaggaacaaacgatcaagccgtccgacacgtccgacggtttgctgatggccccgaatttgcaaacgcgggtgcacacgccgcattcacagcacttttcggcactgacgacggctttgcgctccaccatttcgattgcacccaccgggcagttctttgaacagatggtgcagcccttacatttttcatttacgattaccattgagcgtctcccactttctcatcagatcgctttggggctgttgtcagtcccgcttcagatcactttcgcagcgcgtttgcaaggaggcgtattgcggctcttggcggccttgataacgccgtcgaccataatgatgctcaggcccggaatgtcgccgcattcgaacgcctcgacagcagtattcgccacagaacccatcggagcgtccatgaataccaggtcagcctcgcggcccacggcgatgataccggtattgagcttgttataaaccttggcggagttgccggtcgccatgcacagggcaatctcgccggggatgtcggaaacggaagcgacctgacagatgttgcgcaggatgcccagcgggataatgccggtgccggaaggcgcgtcgtttccgaaaataatacggccgagctggcccttctctttggcgcggcgggcaacgtagtcggtgactttcgggttgccgcactgaacgatctccatcgcgaaatccgtttcatccatgagcttatcaacctcactgagcggaatcgcggtcgggccgccgttaatatgggaaataacatccggctttgtggccataacctgggccgcggtgacggtggaggaaccggggatcgaggtgccgcctgtgtgcatctgcaccttcatgccgttcttgtgcgcccactctaccatcggcgccgcgtcggcgggatccttcacgctgccgagtccgatttcaccgactgtccagacgccttccttcgccatctcctcgaagtccttttctaccaagcccttttcaagtatgacgctgccgccatgaacctttacgccgccgggcttgagcgccgcgaacgacttatgcgccaggatggccagcgccttggtgcccgcgggatccttgggacggccgggcgtatgacactcgccggcggaaatgatcgtggtgacgccgccgtgcagctcgccttcgatgaaattgctggcaaactgacgatgcgcgtagtcgcccagactggtatgtacatgtgtatcaaacaaccctggcgtaacggtagaaccagccgcgtcgataaccttctcagcctcgataccgttcgcgatctccgcgccgccgatggctgcaattttgccgtcggtgacaacaattgtgtcgccctttaaaataggattgtcgatatcaccgctgagaatggtactgatgtttttgatgacaatggaactcatagcaaaaacccctttctgtttttatccggtctgtaacttatttgtatcccttgcggggagatcggtcataacggaatgtggcgggcgcctgttaaaaaacaggcgcccggctcgtaacatatgtatgccgccgtccgggatgcggcgctttcatcagacgagtttgtaatcgccctcctgaatccagccttttttccgcataaattcggagatgacaaacgccagaatggcgggaagcacgaaacagatcaaaagcattccaatccattccatagcgccgggcgtgatggccgtcatacctgcattaattgcattctcgctcggcgtcagccatccggtgacaacgccgatcggtccaaccagaccggcggtacccatgccggaagaaatcggagcgccgttcatggtcaagccgaacacacaggtcgcaatcggcccggtgatcgcggctgcaagcgtcggaggcagccacagaatcggctttttaagcaggttggggaccagcagcatggaagtacccaagccgatcgcagtcaaaccgcccaatttgttttcacgataggtgcagaccgcaaagccaaccatttgggcacaacagccagcgacagccgcgcctcccgcaagcccgacaagtccgagcgccgcacagacggcagccgagctgatcggaagcgtaaggacaatacccatgataacagacaccaaaatacccataataaacggctgctgattggttgcccacataatgatatcgcccaaaataactgcgatttcgccaatcggcggtgccaagaatgttgcaagcagtacgcccacaacgatggtgactgtgggggtaacaatcaagtcaatcggtgtgcgcttggaaaccagcttgccgcagaagatggccgccaggctgataacatagacggccagcggtccgccgccgccgcccagagcattcgccgcataaccgacagtcgccaaggaatagagcacatacgggggacagcccattgcgtaaccaatagccagagccatggccgcaccctgaaccgctgcggtatatccggagatttccaaaagaaaagcgccgacgcttcctggaataaatccgccgatagtcttgatgatggtaccgatcagcagcgacgcgaacaagccatgagccatgccgcctaatccctgaatggcaatacgattaaaggaaagctcgatgttttgttccttgaaatactttttgatgccggttagttcctgtgcgttgttttccatttgcatagatttcctcctcctcgattcgtaagctgtgtctggcgcgcaatgcattgggaatatttcccgaccgttcccccgccggccggttatctataccacacgccgaaaccgacatatggtatattcaactttatcattgattttcatcttaattatattataataatatcgtatgatttttttgaccatttttgtgtttatttcaaattattgtagttaattatcacaataaattaattgaaacacagcaaaattgcagcaaattatttttttaacatttatataataccacattgggcatatgatttcaaatacaataaagttttgcaaaacgcctcattatacattttttatatattgatatactcaataatatcaaaaatattaaagctctttttgtgcaatgacgccaatattaaaaactatggaggagtttttgtgcgatgacactaaaacagctggagtactttttggagatcgcgcgactgggcaatgtcacccgtgccgcccaaagcctgaatatttctcaaccgccgctcagccttcagctcaaatcgctggaggacgagcttggaactccccttttccggcgtgacaaacggcatctggagatcacccccgccggcaagctgctccaggaacgcgcccaggcgatcctggcccttctggatgaaaccaccggtgatatccatgccctgtcaaccgaaaagcagatcaccctgcgcatcgccaccatcggttcggtaaacaaccgcctgcttcccaatctcatcgcccgtttttcccgggattatttctatgtcaattttcgtgttatcgaagggaggaccgagcatgtcctggagcatgtaacatccggtgatgtagatttcggcttcgtccgcgaaccctttaacacgtcccattttcgttcggtcttgattcacgatccggccttagcgccaggtcagtccgaccatttcgtcaccattgcgcagccccaattctatgacgcatattacgagggcggctcccgcgacaccatcgatattgacgagcttaaggataagcctctgattattcatcagcgttaccgcgagatgatccttggagcctgccgcaagcgcggcttcaatccctatatcatctgcgaaaacgacgaaatccattcctccctgagttgggcacgggcgggaatcggcatcgccattgcgccgtatacctcagccatcctcagcatcgatccgggactggtgatccgccgtctgacctttacagccttcattccctgggtacgtctggtatggaatccgtcctgccagctttccagcgaagctcttgcctttatgaatatgatttgaccaatgctctcactccggacaagcttataaattttagcggttgtgaataaagctgcccgtgcggtcaagaattctttcaacgaacagttgggaggattatccatgaaacgctttcacacaacacggttcgattgtgccgttttgctcggcatcgttctttctgtcatgctcgccaatctctccgtgtttggccgggaatgtgcacaggtacgcggcgatgttgtccgtttacatatccttgccaattccgacagcggctatgatcaaggtctcaagctgcgcgtgcgcgaccggattcttgcacaggtcgggggcgttttcagcgcgcagcaatcgcaggccgacgccaaagcggcagcggttgccagtctgccggaaatcgaagcggccgcgcgcgccgcgcttattgaagctggctgtgaagcgccggtgcgcgctgaggtttgcagcatgtatttcacaacgcggcagtacgacgatctgtccctgccggcgggcatttatgacgccgtgcgcgtgaccatcggcgcgggcgccggacataattggtggtgcgtcatgtacccgcctatctgtctgccggcggccgagcctcctgaatcggccgcactcactgaaatagaagcgttaaacagcgaacctctttttaaaccaaagctcgccgttgttgaattgcttgaacgtttttttccatcgaagtccacctccgaaagcgccatataatcaaaaccggccatccgggcattttcagcccggatggccggtttctttatccagtaaattctcaacccactgatgagcattttatgcgcggccgcttctttgaaagctcgatatgcttaccccaacactcacgccactaaaccggatggcggttccaaatgtccctcagccggcttaggcggcaccgccgggcctaagcccgattcaggcttcgccgctttgggaccatcggcggggccggagggtttcgccgccgggcctaagcccggttcaggcttcgccgctttgggaccatcagcggggccggagggcttcgccgccgggcctaagcccggctcaggcttcgccgctttgggaccatcggcgggaccggaaggctccaccgccgggcctaagcccgattcaggcttcgccgctttgggaccatcggcgggaccggaaggctccgccgccgggtctaagcccggttcggcagaattcgccgcaaatctgccgttcagttcagctggaacagccgcagaaatgccgccattcggtccgcctgttgcagccacgccgctgtaggcatccgggccttgatccggcaggttttgattagattccgccaccggcaaaaaggcagaaacactatttaaatgaggcggcagagggcgtctgataaaagcggcgtaaagaagccctattataatagatgaaacaatgaatccaccgattgcaatatggctttttttcacatacattttatcatcacctttttcaatacatgatttgtatgttgaattagcgtctgattggaaattaaactttctccacaatctgctttgtgtcgcgcgcaatcaaaagttcctcgttcgtcggaatcacccaggtctccacgcggctgtgcggcgcagaaatattctgctcacgtccctgcgactccctgttgatgacctcgtcaatatttagccccagaaaagccattcccgcgcagacgcgcttgcggacatggtggtcattttcaccgatgccgcctgtaaagacgacggcgtcgatcccacccattgcggcggcatagctgcccacgaattttttgatctgatacgaaagcatatcgaccgtcaactgcgcgcggggatcgcccttgtcagcagcgcgggtgacatcgcggttgtcgctggaaatgccggacaggccgagcagaccggattttttgttgagcatatcgctcatttccttcatggacagaccttccttgtcagccagataggtgacgatcgaagcgtcgatgctgccggagcgcgtccccatgatgaagccgtcgagtggtgtaaagcccatgctcgtgtcgatacagatcccatttttgatcgcgcacagagatcctccgttgcccagatggcaggtgataacgcggctgccggtgcggctgatatcggaaatttcaaagagacggctgctgacataccggtgactcgtcccgtggaacccatagcggcgcacatggtatttctcataatactcatagggaatgccaaacatatacgccttttccggcatcgtctgatggaacgccgtatcgaataccgcaacctgcggcacatgctcgccaaacaccttgcggcaggcctcgatcgaaaggacggcggctgggttatgcagcggcgcaagctcacacaggctctcgattttgccgagcacatcgtcggtgatcaaaacagattctgtaaaatattcgccgccgtgaacgacacgctgtccgattgcgccgatttcaccgatgttttccagcgcgcgtccctctccctcgatcagatgccggaccagctcgcgcagcgcctccgtatgtgtcggaaatgcgatttcgctggtgcgcttgacgccgtccgggccggtatgcgaaatcgcgccatcgatgccgatgcgttcacaattgcccttagcgagcaccttttcgccgtccatatcgatcaactgatactttaaggacgagcttcccgcgttgataaccagtaccttcatgcatgtaactccttttctttgttcacgcgcccgtttctccgtcaaatgggacaggccgttctttttctcttttttacagtgcaaacttgacagacttctatacagttatatattattacaatatcacacaaattacaagcatggattttatatggttttgttaaaaaactatcattgttccacgctatggaaaggtccgattgtatggaaaaaatggtggctgcgggcattgtcgctgaatacaatccattccacaatggacacgcctatcagatcgaagcgacccgcgcagccggcgcgacgcatattgcagccgtactcagcggcaactttgttcaacgcggcggtcctgcgtgcgcgcccaaatctgtccgcgccaatgcggcgattgcctgcggcgcggaccttgtgctcgaactgcccttgccctacgcgatggctacggccgaacggttcgccgccggcgccgtgggcctgctcggcgcgcttggctgcgtggatgtcatctcctttggaagcgaatgcggcgatctcgcattgctgtccaaagcagccgaagcaatctgctccccctactgcggcgattatacgaaaaacctgcttgaaagcggcgtcacctacgcgcgcgcccgacagaaggcggtggaacaactttacggacagcaggtcgccgaggttttgtcctccccaaacaacacgctggctgtggagtacctgcgccagatcgccctgcaaaaactgcgcatcgcgccgttcacagtgacgcgcggcggcgcgcgccacgacagcggcaaagcggatggaaaaacggcctccgccgcactgctgcgcaatctgctcgatctggagggcattgaatcgatcgctccgtatgtccctgcgcctgccctgcaaatctaccgggccgcggcggccgccggacggatgccgtttgattcgcacagcctcaataccgctgtgctcgcccgcctgcgcatgatggaaaaggacgccttttcccgcctgccggacatttcgggcgaagggcttgacaaccgcctccacgatgctgtgcgctcgtccgtctcgctcgatgatcttctcgcgcgaaccaaaacaaaacgctatacgctcgcgcgcataaggcggcttgtctggcacgcgtttctgggcacggacgcggcgctcatgcgtttgccgccgccgtatatccgcgtgctcgcctttaaccgccgcggcatggagctgctttccgccgccgatcaaacggccagtcttccaatctcgcattcgctcgcaaagctggaggcgcacgacgacgtctgcgcacgctttgcacatctcgaagcgcgcgcggcagatctctatgcgctcgggctgcccggcgtgctgccgtgcggctctgattacacacagaaaatatccgtgcacggataaccgcttgcaggacgaatccatccgtggtatactggtcatatggcagatattgcctgtacaggcccttacggatgaatttggaggtgcttttatgccaatggatccgatcacaattcgttcaagcagcaacagcaatctggagatcaacgcaattcccggtcattttgtaaccagtcattcacacatcaactattatatcgatatcactgcgatgaagcacgatttcaccatggcgcgtgaagctgcggaaacgctggctggacgcttctcgtatgaaaagcccgtcgatacgatcatctgtatggatgggaccgaggtcatcggcgcattcttggcccaggcgctcgcaaaaagcagcgcctacactgtgaacagccagaaaaatatctatgtcgtgccgcctgaattcagcacaaatggacagattattttccgcgacaatctggagcctatgattgccgatcaccatgtcctgctgctgctcgcttccgtcacaaccggtaaaacgatccgccgcgcgctcgaatgcatcgcctactataagggttacaccgaagggatcgcggccatattcagcgcatgtgacgagatcgagggccatacaattcaccatctgttctcctgcgccaacatccccgattatacgacctgctcgttccgcgactgcaagatgtgtcatgacggcatccccatcgatgcgcttgcaaacagctttggattttcgactctccgataaactcggctgttcctaagcaaaaaggctcccgcccttgggcgggagcctttttgccgctgcacggcggacgttccagaggtctgtttgaaaatagaggaattaccgaattttcaaacaccccctggtttccaagcagcctcaaccgcccgcttcgaagctgcggcgtgtatatgcatactttgcaactaaaaatgaaacagccaacgccgcaaatcccgctgcccaaagggccggtccggcgccgcgaggcaatcgccacgaatcgccgcttttggcgatcccacggccgaaaagcgtcgcaccaagaaataaagcgcagaacagcgccagaaaccacttctgcgcgcgtattgcgccaagcgtatacaaaagcgccagcatcacggccgccagtaacgcccccgcaaaaaaaccgacagccatgccggcgtctgtcccaagccggttcaaggcacgcggcagcagcggtgcggcggctccgttgacaagccgcatgatcgcacacaaagccaacagggacgcgccggtgaacagatagcgcgcgcagacagcctgcgcgcgcgttaccggcagcatgcagacagcggcgctcaccgcgccgtcgtccgcagccgcggtgcaggaaatcacccaagcgcccatcaaaaaaccgatgaccgccagaacgtctgacattgaaaagagcgccgtctcaatcaggactgccgccgcgcttacaggcgcagcgcaaaggctgcgcaggtcgagcgccagcagccgtgcgatattccgcatctgaatccctcctgccaagctgtaaaactctcccgcttttcagaattccccgctatgccataatctcctttcggctgtaaagcgcctgtgctgcaaaataggagatcagcagcaagccggcccccgccgcagcgggcgctccagtgagcgtcacaccggatgcgtgcgtgttcagcagctcgccggcgataccggagagcgcgaaggccactgcatacatcagcagaattgcgtatcgcgcctttaacgcgccaaagtacaggatcagcggttgcgtaacggagacgaacaccgcgcccatcaaaaacagcagcgaaactgattgcattgcgtctgttttggacagcgctgcaccgatcaggcagattgccgcgagcgccagcaggtcatataaatagcaggcgcgcacgatttggcgccgcgtgagcggcagcgcgtgcagcagataagcgccgtggctttggtcgtcatatgccggtaccatgtagatcagcagatatagaaatacgacaaacactgccgaaatacccgacgtatatccgatcacgcagacgagcgcagccacaatcagaatcatttccgtcccacaattgaacagctttaaaaggttcattctgataaccgccagaatatcagacatgatgcgcagcccctttccctcgtgtatacgccataaacaaatcctcaatggttggtttttcataaacggcttcattaccgaacagagcgaatgctgcggcttcatcctcacataagccccgaaaaccaaaatctgattcctcaacgccgcgcaaaagtgcgcgcgcctgctgcgtcaacagctcacggcgtcccttgaccatgcgccgcgtatcgatcaaacgatccttttccccctccagcagcagttcgccgccatgcaaaaaaatcagatagtcggcaatcttatcaagatcggaagtgatatgcgttgaaaagaacacgcttaccccctcctgttccatctcctccgcaagcagatccagcacctcctgccgcaccaaagggtcgaggttggccgtcggttcgtccattaacagcagttttggccggcggcacagcgcaacagccagcgcaaactgcttctgcttacccttggacagagatttaaacttttgctccggcttcaatccgaaccgctccatgtaccgcataagcgccgtatcgtcccactggggataaaacggacgcatcatcgaagcaagcgcccgcaggcgcgcgtttgccagaaatcccgtttcctctccgacataaccgatttcgcgccgaaccgcctcgccgtcagcgcgcgcatccagcccgaatactctgactgtccccttatcaggacgcagcatatccatcagcagcttgatcgtggttgtttttccagccccgttttccccaacaaagccggtgatatatccctcccgtacacaaagcgatggcagggaaagctgaaaaccgcttttatggaaacgtttttccaggcctgctatttctattacattgccgttcatggctgttcctcctcataaagcgttttcgtgatctcccaaagctcctgcgctgttaaaccaatcgcacgcgccgcatcgacagcttcgcttaatcgctgctcgatctgacttaatgcaacctcgcgcagacggtcgcggctggccagggaaacaaatgtccccttgcccggcgtcgtcgaaagaaatccctgcgcctccagatcgtcatatgcgcgtttggtcgtaatcacactgactttcagctcccgtgccaaatgccggatagagggcatcggcgctccctgaccgagccggccggcaaggatttcgtttttgatctgttcctcgatctgctcatacagcggacgcggcgaggagtttgaaatgataatatccagatgatcgcctcctccgttattatctgtatatttattatatatacagataatatcattgtcaagcggcttttattagaaaattatgtttatttgcccggcagccaattaccctaaaaactccatagagcgtgttgacataagttgaaattgacacattttgagcagaatttttgtcctgccaggcaaacattcgttacaatccctggtgaatgcagaaatcattaacgacgtaaggcggaaatttttccaaaaggtagtggtttcacactcgtgtcgaaatgttctaagctgtaggcgcaccgcgtataaaattttacagtttttttcatacttttgcgcagcaaaaaaagaagcacaggcccgcctgtgcttcttcacaaatccattctgtctttataaatccatgcttcgcgacgcgtgctccggcagcggcgtgctgttgacaatattgtcaagcagggcgctttgttcctcataattaccgacactctgcgcgtcatgattgacggtgggggaatcggcacggcgcaaaagcagatacatacgcggcagcccctccagccccaaagcgtttacaaacggcttccccgccaaggcataacggtcctgcccgatcacagcgggatcgcccggatagcgcacggataaatcctcaaaaagcgcctctccgccaatctgagaatagacgtaatcgtccactataaacagatccgatttcccatcgcggatcgttgtcagcagcgctgtcaacggcgattttccggtcagatctccggctgcggggaattcgtaaacgtcgagcgaaatcacgctttcgctttcctcctgatatccggacaactgcgatttcagcgcctcgcgctgctcaacggatacatatccgcgcacagcgaccacgaccgtattgacgccgtcgtcccgcccttcggaaaaataatacgcgagcgccagcacgaccgccacgaccaacgcaacgacgaaaatgcccatgcgccgtttatgcacaatgcgggcgtcacggttcttgctgctgtcgatggccgatcgcctcctttcgcagaaccctcctgattatcttgcttgactgccgggcaatttattcgcggacgggcttcatcgtcgggaacaaaagcacatcgcggatcgacgcgctgtttgtcagcagcatcacgagacggtcaacgccgataccgagtccgccggtcggcggcataccgtactcgagcgccgtcagaaagtcctcgtcgatatcgttggcctcatcgtcgcccgcagccttgagcgcggcctgatgctcaaagcggccgcgctgatcgattgggtcgttcagttcgctgaacgcgttcgcgtgctcacgcccaaggataaacaattcgaaccgctccgtatactccggctcctccggcttacgtttggacagcggcgagatatcgactggatgatcggtgataaaaacaggctggatcagatgcttctcacaatactcctcaaagaacaggctgagaatatcgccctttccatggcgctgttcatattcaatgtgatgttcctttgcaatggcacgcgcctgttccagcgtctcaatctgtgcgaagtcaacgccgctgtattttttaaccgcctcacgcatcgaaagacgctcaaacggtttatccaagtcaatttccacatcgccgtacacaattttgcccgtaccgagcaccgcatgggcacagtgacgcaccaaaccctctgtaatatccatcatgccgtggtaatcggtgtacgcctcatacagctcaagcagcgtaaattcaggattgtggcgcgtatcaatgccctcgttgcggaaaacgcggccgatttcatataccttatcaaagccgccgacaatcagccgcttgaggtgcagctccagcgcaatgcgcatatacatatcgatatcaagcgcgttgtgatgcgtgataaacgggcgggccgccgcgcctccggcaatcgcgtgcagcacaggggtttcgacttcaatatagccttttccctccagaaatccacggatcgctgtaatgatcttcgagcgttttacaaacgtatccttaacttcgggattcacaatcaaatcgacatatctctgccggtaacgcaattctgtatcctttaacccatgccatttctccggcagaggcagcagtgattttgacagcaatgtgatttcatgcgccttaatggaaatctcgcccttctgggtacggaatacttcgccgcggataccgacaatatcgccgatatcccattttttaaaatcagcatagggttcgtcgccgatttcatcgcgccggacatagctctgaatacggccggatgcgtcgcgcacatcgataaacgacgccttgcccataatgcgccggctcatcatgcgccccgcgatcgacacttccctgccctcataatcgtcaaatgcatcgacaattggctgtgcatatgccgtgcgcgtataagaggttgtcagaaacgggtccttcccctcgtttttcagtgcttcaagcttgtcacggcggatttggagtacttcggacagcttctgctgttcctcctctgcggtcagctctgccccggtctgattttgattttcctgcatgatctaacacatccttcttgttgccgggcgccgccgcgcccaatctgtccctgtgaaccatgtccgcgaagcggcatggcataatcggccatcagagcggcaacgggccgcgcccgcgtatcgccccggccataaggtgtataataaccgctctgcggttattataccatgtccgcgaagcggtatggtataattggccattggggcggcagcgggccattgcccgcgtatcgccccggccataaggtgtataataaccgctctgcggttattatatgcgcgggccgctcaccgccggacgctgcgcttgcccggccggctttggcgcgcgtgacccgtgcgcgggccgctcaccgccggacgctgcgcttgcccggccggctttggcgcgcgcggcctgtgcgcaggccgcccaccgccggacgctgcgcttgcccggccggctattcggggctttccggcggctatagccgccgggcgcggacaagccgcggctgcgcccctcagcgcgcctcatgggacaggggcgggccgcccctatcccatggacccaaccctggggcaggcgcagcctgtataaacgccggaggccgccccgctgtttgcggcgcagcctgcataaacgcagtgcccgccccactgttcgcggcacagccgattaaagttttttggcacacctttttttcaaaaaaggtgtgcagggaattgtcgtttttaagatacttataggatagcaggcggtgttgacaagcgacttatgagggaccgccaagggagggaaaccagtatgacaaaaaaacgatggctgattccagtgctggtgctgctggtgattataagcgcggccagcgcggcattttttctttcgcggccggagggcgatatgatctatgcatccgtcaatatccagccgcaggagcaggagagcacagagccgctcgcgcctgaaagcacgtttgccattacgcttgattacagcgtgtcgcaggagcagttgcgcgccatgctgtccattgaacctgatatcggggaatatacgattgaaggaagcgggaaaaaatggacgctgcgtccggcagtcccgctggaggaaaatacggtttacaccgtccgcgtgatcaatccggataccggcgcggcggtgcagtcgtttgcctttcagacacgcagcgatctgctggtgaacacggtttatcccggcgacggcgaaacctttgtgccgctggaaacgggaatcgaactgactttcaacgcgcaggatgttgatctgcaaaaccattttgaaattaagccggctgtcgccgggagttttgagacaaacgggtatacagttgtctttaaacccacggagccgctgacggccaacagcatttacagggtgacgctcaaagccggattgacggcgccgggcggtatggcgcttaaagaggattatacgttttcgtttgagacggtgcaggcagaggatgcgcagcgcgattatgagaagctgcggcttgacggcccgtatgcggagacctttttgccgggcgatccgctgacagttaagctgcaaagcggcggcgaggtatccgggctgccctttgaggtcaaaatccatcgttatggcgacatcagcggatatatgaaagagctgcgcgcatatgacgcgttctatcgggagcggtacggcgaaaagacggaatatgtcgccaatacgaccggcctggaagaagttgcgtcctataccggcgagctgttttccaaagatgacggatggggcgaattgtatgcgatcctgccggatgatctggcggaaggctggtatgtcgtcacaatctccggggaggacgcttccggcgccgaccagtttgtacaaaagctgatccaggtctgtaatttgagcgtttatacacagtcggccgacggcgacacgctgttttggctcaatgatcccgcaaccggcgagccggttgaaaaagcgacgctgcagcttgaggatgtgaacggtgaaggcgagtttccggcggttacaatggccgatggaacggcgcgcgtgatgacaggggagagcgaagccgcttatttaacggtgctgcgcgatgggaaaagcgtctatttcgcgcgggtgcccctgtcgcaagcgatcgagacgccgccgctgtccgaacggtattatacggcgctttataccgaccgcgaggcttaccagccgtcggataccatccatttttggggcgttgtcaagccgcgctccggcgacggtacgctgccgcagagcgtatgggtgtcgctttccacctcatggccgcgtgcggaggtttaccgcgtgaaagcggctgtcaatgaggcggacggcacgtttgaaggcgcgattgccgtaaccggcatcgccaaggattattatgagctttccgtcaacgacggcgagcagggcgtttacacctccaaggggctttcgctcgaaaaatacataaagccgccgtatgaaatcagtgtggctttggataaggaccactattattttgatgaagcggttggcgtttccattacggcgcgttattttgacggtacgcctgtttcaaatgaaacgcttacgctgacaggcgcttacattaccgagcaatccgtgacgcttgacgcatccggccgcgcgaactgcacagtcaggctgaaagcgccgaacgatgaaaacgatccgatgggctggtcgccgcgcagcctctggattgaggcgcgcaatgcgagcgcccaggacgtttatgtttccggcagcgccaatgcggcggttctgccttcgcgcgtcgcgctcaagctggagggcgattccctggagaagctgacggtgcgcacagcgcagctcgatgatacgaaattaaacgatgatcattccgtcagcccgctgaaaatttatgacagcgaatatgaccggctggcgggcgcgcctgtcgatgtgccggtgacggtgctgattcacagcgtcacacgccgtcaggtggaaaccggaagttattatgattatgtcaataaacgcacggtgacagaatatgaaacgcagcttgacgaggcggtcgccgaaacgattgagacaaagacaagcggcggggttgttgtaattgaggggctggattacaaaaatgcggacgatacaacctattgggccgaggtgcgcgttgacggcggcgcggccggcacggtttctgaaacaaaccggttcggcacgcggccttatggattcagaggcgacacgccggtttatacctttgtcaatccggatgatgaagccgcgaacgcgccggtcgatgtgggcgatgcgatcacgcttgggctgtaccgcaacggtgtaaaaaccgaaaatacaggccgtgtgctttacagcgtattgcagcgccggccgctcaaaaatggaatttttgaaggggattcgcagacgttaacaatggaggaaagcttcctgccgaacgttgtcattgcgggcgcctattttgacgggcggcatatctatgccgtggaggaatatgcggttgattatgattacacggacaagggattgaatgtgacggccgagacggacaaagaaacgtaccggcccggcgaaacggcgacggtgacggtcaagctgacggacgcggcgggaaatcctgtgtccggctccgtctgcgtgggcgtggccgacgaggcggtgttcgacgtcgcggagcagcacgcagagctgcttgaccagctttacagggcggtctattatccgcgcctgcggcgcagcctgtcgtatgcggaatatgataccggcgctgatgaaaaggcaggtgccgaatcaggggacggggcggtcccgatgagcgccaataccggcggcaacgcgggcggcgtattgctgcgcgaggactttgcagacacggcgctgtttaaaacggcgaaggccgatgaaaacgggcaggcaaccgtaacctttgagctgccggacaatgtaacctcatggcgcatcacggcgctggctgtgacaaacgatctgaaggccggcgacacggccgaacttgcggccgcaacgctgccgttttacctgtcgccgctctatacggatacgtatctggagggcgacgacgttgtgatcgcggcaggcgctgttgggaccggtgcgcataccggcgacgcggtttcgtatacggtcacaatcgccgacgccgcgggcagggagcttgacaaacagaccgccgaaggaaccatcggcgtgcgcgtgccgtttaccttcggcaagctggaggcgggcgcttatacgctgacgatagaaggcgtgtgcggtgaaaacagcgacgctgtgcgttatccgttttctgttgtaaagcaggcgctgacaacgccggtttatgaaaatatgccgctcaaggacgccgttaacattgaatcggtgcgttatccggtaaagctgatggtgtacgaccggcggatgcagccttatatggaaggtttgcagtatctttccatgcaggcgggcgaacgcacggagatcatcgcggctgcgtaccgcgcgcagcttgcatacaatgagctgttggacgaagcggaccgcgagccggtgcgccgggacagccgtctggatgatatccagaatgacgacggcggcgtgcggctgctgcctgtgtctgaaagcgacgccgctgtgacggccaagatgctggttgcggctccggaactgatcaacaagggcgcggcgcgcgattatctcaagggcgtgctccaggacccggccgctacgcaggacgaccgcgtcatggcctatctggggctggcggcggcaaaggaaccgattttgcttgatctgctgcgcatcatctctgaggagggcgcgtccatgacagacgcgcagcgcctctatctggggaccgggcttgcgctgcttggagactttacatcggctgatcttgtttataattcgcttggcggccgcctggttaaggacggagatatgctctatgccgaaggcgcggacggcacgctcgacgcgcgcattcaaacgtcggctgcggcgctgatgcttgcgtcggttacatccaatccggacgccgacgcgctgatgcgctatatgaataaccttgaccaggaccgtgcaaagagctacagcacaattgccaatttggagatgctttgctatatcaattcgtttataccatcacagaaaggagcggaaagcttcagctacacggatacgcagggtgaaacccaaaagcgtaccctggaaaacggcggtgtggaaccgctttccatgagctatgaggcgctggcggccgccgatttccaggcaaacgatcatgtatatgcctgcgcgctttacacaggttatgcagacgcggcgcagatcccggatgacgaacgcgtacagatcaccaagacatatacgccggtcgccggcgatgggatcggcgtttccgacagggtacgcgtcgatttaacggtgcgcttttccgatgacgcgcctgacggctgttatatcgtctccgattatatcccatccggtatgcgttatatggaagcctccggcgtatcggagatcaatccatactttgattggatgtggggccggatcgacaatgaaggccaggccgtttttgggcgaatctaccgcaatattgccgtttggcgccagtcccaggcggcgcgcgccggacagcagtccggtgaaagggcggtcccgctgactgacagcgcggcggccgaagaaaagatgatcccttcaaccaacggtacggtggtgcaggaggacacgaatgtatataccctgacgtattatgtcagcgcggcgcttccgggcgaatttgtttcggaaagcgcatatgtaaccccgtatatcgagggcgcggccgctaagagcgagcgcggcacggtaacgattgaggcggagagctgacaggcggttttgtatgggcgcgcccccggcgcaggtgctttttcgcagaaaaagcccgcgccgggggccttggcgggccgggcggccgcatggccgcccggcccgcctttttgccgtttccccatgcggggaaacggcggaagcgccgcgcgctggggcgcgcggcgctccctgtgaggcggcggcgattgccgccgcctcacagatacagccgccggacgcgcgaattttccgcgcgtccggcggctttccggtggtaatttgaaaaggaatatggtacaatatgcgcagagcaaacagcaagctgtttgcagccgccagatagcggctgccgctgcaaagcagcgaaactgcgcccgcagtatacgaaactgcgtgaaggcttttaaagcagcagccgcgcagccccaagccctgcgagcagcagtccggacacgcaggccagcgcgcgcttggaaaccggcaggcgcgcaagcatccggccggccagcgcgccgagcgtcagacagatggtttgcacgatccccacggcgggcggcagccagacagaggcggcgccggcaagcgccaacccgacgcccgcgccgagcatatcgaccgaaagggaaaagccgagcagcagcgcctcgccgatatcgatcgcgccggagccgtcgagatctcccgcggccggttcgcggatgacaaggatggtcagcccaagcgcgcgaaagcggcggcgcaccggcggacgcgggggccgctgcggctttggcgggagcagagcgcggatacagcaggccaggccaagcgcaattaaaatcaatgcgccggcggcgcgtccggcccatgccggcaaaaatgtgccgagcgcgccgccaagcaggattgctgcggctgcaaaggcggtggacagcagtgcgatcgcgcccttggcggccgcgccgattttgacgccgcgcatgccaaacgccgcgcccgcggcgaacccgtcggcactcaaggcgagtgctgtaagcaagacaagcatgtttatgaaacaccacccggtacaatgttcattccatactatggattcgccgggttttggtgcaaaggctttggaaaggcggccctgaatatgcgggtcaaaatccctagaaacaagccggtttcagcggcgctgcggatggatggtttgatttttgtattcactggttgtcacatctgtgacagacaatatacttttttccgctggcagactcaatttaaaactctttgattataaagtttcggtaaaggcggtatataggatggataaggttggtttttcagcagcggacattttgcttccgaagcatgtggacatgacgcgctggagcgtcattgcatgtgaccagtatacttcgcagccggattattgggaacgcgcggcgcagatggtcggttcatccccaagtacattgcaccttgttttgccggaagtttatctggaacaggacgatgtcggccggcgcattgcgcagatcaacgcgtcgatgcgcgcctatctggacagcggcctgttccgcgtcctgaatgacagctatgtttatgtggaacggaccgttgcgccggggcgggtgcggcgcggcctggtcggaaagatcgatctggagcagtatgattacagcgcggacagccgttccctggtaaggccgaccgaggggaccgttgaaagccgcctgccgccgcggatgcgtgtgcgcgagcaggccccgttggaaagcccgcatattatggtgttggtcgacgatgcgctgcatacggtcattgagccgctgcaaaagcagaaaaacgcaatggagccgctttatgattttgatctgatggcggacggcggccatatcgcgggctggcgtgtggccggggacttgtgcgcgcaggtcgatgcggcgatgctgtttttgctttcgggtcaacaatgctgccgcggcgtatgccgggagtgcgcgccgccgatgctgattgccgtaggggatggaaatcattcgcttgccacggcaaaggcctgttgggagaagatcaagcccgcgctttccgaacgagaacggcgtgtgcatccggcgcgttacgccctggcggagctggtcaacctgcatgacggcgcgctggcctttgaaccgatccaccgcgttctgtttgatgttgatcccaataacgtcttggatgcgctgcaaaagcagcttggcgcgcgcgcggacgggcaagggcaggtgtttgcatatgcggcgggcggccgcacgggccgccttgcggtggcaaatccgccgtcgccgctggcggccggtacgcttcagggctttattgacggctatcttgcggcgcatggcgggactgtcgattacatacatggcggcgacgtggttatggagctttcaaaaaagccgggaaccatcggctttttactgcccgcgatggaaaaatcgcagctttttccgaccgtgcgtgaaagcggcgcgctgccgcggaaaactttttcgatgggacatgcgtatgaaaaacgtttttatctggaatgcagaaaaatacagtaaggaggctgtctgatgaacagggaacgcttgatccaaacggcgcttggggagaaaaagccggcgcttgtcttgaaaaacgcccggattgtcaatgtattcaccggcgaaatccttctgggcgatatcgcggtgacggacggccatatcgcgggcgtgggcgcttatgaaaatggggaggagacggttgacctcggcggggcgtatgtcgcgcccggctttatcgacgcgcatgtgcatattgaatcgtcgatggtcacgccgccggcctactgcgccgaggcgctgcgttggggcacgacgacgctgatcaccgacccgcatgagatcgccaatgttgccggcggcgacggcgtacagttcatgctggatttatcggagcgtttgccggtcaattattatgtacagcttccgtcgtgcgtgcctgcgacgccctttgaacatgccggggatattttcacggctgaaaagatgaaacggtttctcaaccatccgcgcgtattgggccttggcgaaatgatgaattatccgggcgtcgcggggcgcgaccccgaggtgatggccaagctggagctgtatggcgggcgtgtgatcgacggccacgcgcccggtatctcaaaaaacggtttgcaggcatatatttccgccgggatggctacggatcatgaatcgacctgctgggccgaggcaaaggaaaagctgcgcgcgggcatggcggtgcttgtgcgggaaggctcggcctgcaaaaacctggaggaaatcatccgcggcgttctggccgacggcgcggacacctggcatcttgcgttctgtaccgatgacaagcatctttccgatatccgccgggaggggaccatccggcataatatcctgcgcgccgttgcctgcggcatgaacccggtgacggccatccagatggcgacgatcaacgccgcgcgcatctaccgcctgcacgatttgggcgcggtcgccgccggttatcgcgccgacctggttgtattgcgcgatttggagcacatggaggtgctgtccgtttacaaggacggccaaaagcagccgggagcggcggcgattggctcaatcggcggcgccggtgcgatcctgcattcggtcaggctcgcgcctgttacagaaacgtcgtttgctctgccggattggcagcgttatccggtgatccgtattgtgcccggcaacgtcacgacggcgcgctttgatgtcgatgcggccgaagtcccggcgatgctggcggacggccggctgcgaaaaattgcggtgcttgaacgccaccacgcgaccgggaacatcggcgtggggctgatcgccgggtatggactggcgcatggcgcgattgcgacgacagtcgcgcatgattcgcacaatctgatcgtggccggcgacaacgatgccgacatgctggcggctgtgcgtgagattgaacgcgtgcagggcggctataccattgtgcgcggcggccaggtgcttggcacgctgccgctgccggtggccggcctgatgagccttgacggcgccgacgcgtttattcctgcgctcgaccggatgattgaagaagcgcgcgcccagggcgtcgcggacggcatcgacccgtttatcaccctcagctttatggccctgccggtcatccctgaaatccgcatcacggacatcggcctgttcgacgtcgtaaacttccgcccgctccggcctttttgaaaaaaggcctcggcgaaaaactttccggcctttttgaaaaaaggcctcggcgaaaaactttccggcttttttgaaaaaaagcctcggcaaaaaactttagtcggctgcgccgcaaatagtggggcgggcgctgcgtaaaaacaggctgcgccctcaaccccggggcaggcgcagcttggcggtttaccacagaacgcaccggcgtgcgcccgaaaagtccgtgccaaacaggggtggggataacataaggggagggtcgccgaccctccccttgtgaggcgcgctgaggggcgcagccgcggcttgtccgcgcccggcgctatagcgccggaaagccccgaatagccggccgggcgagcggagcgcccggcggtgagcgacctgcgcacaggtcgcgcgcgccaaagccggccgggcgagcggagcgtccggcggtgagcgacctgcgcacaggtcgcgcgcgccaaagtcggccgggcgagcagcagggtttggggaaggcactccccaacaagattcccgcaggggcaaaatgagcgaaaagcgaattttggtactgcggtagaatcttgctctaaaaaactaccgctttcctcggcggctctggtttgtggatatactggcttgctccaccaatatagcgattgcggcggcgtgttctgcccgctgttcaccactacaacggtgaaaagggggcgttttggcaaacgcagcggaattttttttgttttccctgtctgctccctacaacaatccggcggtgtggtttgccaaagatttttgaaaatggacgcaaaaaaagcagtaaaccttttcaagatttactgcttatctgccgctgtgatgggcggcggtattaaattgtcagccgtttttcaaatggaatttatctgcaatcgctttctttctgctttccaattccttttctgtaatcttccataatcctaacgcaatgatctgctatcttttgcattccgagttcttcaaaaaaggcaatttgtattttcatcagttcttcacaaacagtcaacttctgctcatccatattgctaatagcaagccatgggaacgctttatatttcttagtgtccccaatgagaaaattgtaccctatcaactcattttcacggaaaacgaaatagaattgtgggcctgaacctggaactgacttttccataatttgctgcattgttttcacgccgccgtatgccggaaaaaaacctattcgctcaagagcatttaatatgtcaatccttttatctgtgggtatgtctctataattgataatctgttccatttgatctaccctcattgaagtttaatttgtcagcctctaattatacaacttttctgtttagcggtcaaagcggaacttcaacaggctttctatcagttgcctgacgatatgctcctgcatatccgtgttaatctgtccgtccattttcgcacaagagcggatatatccggcataatgagatagaacggcggcaacagcttctgggtcgccctcgcttgccttaacgattgtttcatagggaagtagctggttcataggacaagccctccaactctgcccgtagctgccgtaaaatcatctgaatacgccgcccggttgtgttgccagcccgtccatatctccgtccaatctccctatgcgtcaatcgttggaagtagtacaggaaaatgatttcctgttccatctgtgatagtgcggacagcgctgcggcaagctctggactttccaaaagcaccatctgaccacagacgaaaagcggatagctgttcatggcagcttgctccgcaaagtatttatctgtggtgctgaatggatagtgtttttcttctatcagatattcaagcgagatttcccgcttgcggcggctgcgtatgctccgggctgcgtctatggcagcgtggcgaataacagtcttgcaaaaggcatcgtgtgtatgccggatatgttcttgatacttttcgtgttcggtcatggaaaatccccctttctgaataatggcagagggcggcagcatcttgtgctgtcgccctcttgattaccgaacagcaaagacgggcggggctgtcaacggcggcacatttccgccgttcatcttgaccgttgacaggctcggctgggtttgctatctgctcacggcaattcactctcattgataggaattgcttcaagttccgtattcaaattgttccaataagagccaatatccgcacttgtgaaatacttaaaaccgcctgcttctgacttcaattcgccgtttttaactccatagcaggcgtaaatcaaatcgtagcttgttccatctgagaggttaaatctaaagctggtcacatctgctccagcagtttcctcagttgttttgtcttttagggataagcccttgaacttatcatacagggtctttatatcattttcagcaacaactactttcttttctgctgatgcaggcactccgtcatagtggtacatttcaacgctttcgacatcttcaacctcaaatgggaagtcgattttgacaggctcataagcaatgtttataggtaacagaaagagagctgtaaaaattgcaatgatacaaagagtgatggaaacgagaacagcaatagttatcttttttctgcccctctgcttttcttttgcctcatggcgcataataacgctttcgctttcttcgtgaagaacatcttcgctcgtgtgagaaagcaatttctgataaattgcgttacagtcagcacaggcgttcaaatgctcttttaccatctctgcgcttgcttcgctgcaagcaccgtcaacatacagcggaagaatatctcgaacaatatcgcattgtttactcatgcttttcatccatcctttcttgaatttttagctttgcacgatgataagtaactctcgcccatgattctgtttttccaaaaattgcagcgatttgtgaaaaagatagttccccgaatacgcgaagctgaaagacttctttgtatggttcttccaaacggtgaagaacgaggtgtatgcggaacgccatgtcagaatctgtaactgagttctcaacattttcatttgatggcaagtcattgatttcactcacatcagctactcgctgacggcttcgcatttcatcatggtaaagattttttgctatggagcagagccatgtcaattcatctgacttacctttgaattgtgatgttgtagaaacagccttatagaatgtgttctgcgtgatttcctctgctatctcacgatttttagcaagagaaatagtatacgagtatacctgtaaatagtaggctttatagagcttttcatagtccatacctgtcatcacctccttcagcttcataggttagacggagaaatcggaatttcgttacaaagaagtttgaaatttttatacctttacgctactcttgctttctgcggactattggtagacgcgcattaacggcaagcaaagagattgctgtgtcagcttgatatgttcaaatgctaattaagtatagcatacagctatgaatttttctattgcgttcccctgacttcggaatagtggcagggctggctatccatgtcttgtgcttctctaccgtacatgagcattaaagcggggcttctatccggcgctgccgtgtcagcacataaatataggggccggcttgctgctttgttcagagattattcatatatttgtataaatgtgtttgataagtggaataaaaattacaaattggttacaaaaagcgggcgaaagattacaaattggttacaaaatccgttgactttttttgtatccctggggtataataggaacagggaaggcctggactttcccggggaggcccacatgaaacgattgttttgtctgctgctggttgttgcgctggcatttggcgccgcgccgctgggcgcgtccgccgcatccgccgccaacggctcggtggcattacaactgaataacgacggtgcggcggagctgattgacgccgacggcgcggttcgcgctgtcagcgatccggcttcctccgacgcgggcagcttcaaatttgaggctgcgcccgatcagacgctgtatttatgcctgggcgtctctgacggcggcgatacgtccatgctgtggaatgattccgtgggtgatctgaccggcgcggcgtcgcccggtgagctggcggatcaggagctgtttaagctcaaggtcagccgcgacggagatggagcgcgccttgtgcgtgtttcccagtacaatgagcgagccatcggcggcagcgcgcgcagcgcatggctgaaaatcgatatcgcggcaagcgattccattgacgagcagaaagcggtcgtggatctgacctttactgcgcgtgacgacgatgaaaacggtaaatgggagaagggcgattatgcgcttttgcgtttgacactgtggattggcagcgccgttgaggagggcggggatgctctgcgcgccgcaggggattcgtttgtatataagcctgattccaattcagagaacatagtgacatgggaggacgtggcgtcactatcgttttccgcgagcgacgatgcgaaaaagttttacgcccgcctttctaccaagcacgatccgatttatgcggcgtatgaggacagcgcggatctgtatttccgcaattttaccggcgcgcccacaatttcagcgtcctcgcgtgcgacgttgacgctgtattatccgtgggaggatgaaggtcccgatccggcggcctgtcacatctatctggcggatgcggacggctcgctgcgcgatgttacaaagctgtttacctatatcggagaagatgaggatggcagcgtggtgaatggctggcggatacgcacacgcacgctgggatgctatatcattacggaccgcgcgctggatttgacttcacagcaggaacaggctgtccaaacgcagcctgagacagcctctgtcccggagcaggcttctgtgccgcctgctccagaggatgctgcggcattgccgtttgatatcaaccgcaatgcaaaaccgatcccgaatacagggatttaaaaataaacgcaaagcgtttattttatccttcatggcaggacgatacgcgtgcgcagcccgctgccgccctgatggccgattgtatcatgccgcgctgcggacatgatataatacaacgcgcatggtctgcctatgcgcgttgtattttttattgcgaaaaaagggcctgtggattttcatttggtacgtaaggacgttttttgcagggagcatttaatagaccgctcctgtttttaaagccggatttgacggtgaaatggttgctttttcccgggcattatgctataatccatatacttcacgtaatgattgattggttcataaacgcctgtttaaaaaatttttatcctcctgcctgcacttgcttattatacagaaagtcagaggcggactgcctgaatctgacgaggagaatcggctgcgtacaatggggggcatcctttaaacaggacttttttgttatgaactcgacctgagaggaggccccatgtatgaagcatttgtcatcctggacgttcgcggcttgtatggctgtttgcgcggcaggcgtaactgtcctggcttatgcgatcagcacgacaattgatctgacgggcacggtgtatgatgataacgggaaggatgtaactgcaaaatatgaggtcttgttcgacgagggaaatgtaataatcaacagggcgcctgtcggtgaaaagctttattttgagatcggcaatggaacagattttcgtgttgtggaaggaatgactgtcgacgctgcggcgcttgcaaacagcgataatttttcctacacgcttgaacgcggcgaaaatggagacttgctcgattatgccaggcttgtaaccaagcggttcgatgatggggaacgaaagcgttattttgaaattgcgcttgtagttccgcaggaggatcaaaagcaggctgttacatttgatctttcctttaaggcaaagcacacggaggatcattattggcaggcaggggatacggcgtccatgcatttcgaattttggatcggcgatgctgcccagcagtcatcgtccgagggatcccaagcgcctgcatcaagctccagccagaccagtacgccggcagtttcgcagactgcatcggtaccccccacccctcagagcgcgcccgaggaggctcccgccccaaccggatcgcatgacttcacggctgccgccgcggccttgatggctgtgtcggctgcggctatcctgttggtgaataagcgccgttaaggttatacacgcgtgcgcgtatatagaagtattgcaaatacatgatccgctggactgcatggtccagcggatttttgtaagcagcgatgtctgaaggcggcaaaatacggcgcagctgggaaaattcagggcgatttcgcggcggctgtatcgagctggaaacggagcattctatgagcatccagacgctcattttgcccctgcgggaatcttgttggggagtgccttccccaaaccctgcttatgcggcttgcgccgctgaaaaaaaccgcaaaatattttttgggatttttcaaaaacagttccaattcaccaccctgtttttctcctattagtgagaggacaccacgcacagaaaggaggtcaaccacctatgaaacgatacaacacgccgcaccgcagccgggtagtcaagacacgcatgaccgaggaagaatatgccgagtttgcggaaaggctttctgcctgcaacatgagccaagccgagtttatccggcaagccataaccggggcagccatacgccccatcataactgtttcccccgtcaatgacgagctgcttgccgctgtcgggaagctgaccgccgaatacggcaggatcggcggcaacttaaaccagatagcccggacgctgaacgagtggcacagtccctatccgcagcttgccggggaaatacgagcggcggtttccgaccttgctgccctaaagtttgaagtcttgcagaaagtgggtgacgctgttggcaacattcaaacatatcagctctaaaaatgccgactatggcgcagcggaagcctacctcacatttgagcatgacgagtttaccatgaagcccacccttgatgaaaacgggcggctgataccgagagaggattaccgcatttcttccctcaactgcgggggcgaggatttcgctgttgcctgtatgcgagccaatctccgctatgagaaaaaccaaaaacgggaagatgtgaaaagccaccactatatcatcagctttgacccacgggacgggacagacaacagcttgaccgtagaccgggcgcaggagttgggcgagcagttctgcaagacacatttccccggacaccaagccttagtctgcacccacccggacgggcataaccacagcggcaatatccatgtgcatatcgtcatcaactccctgcggatttatgaagtcccgcttctgccctacatggacagaccagccgacacacgggcgggctgcaagcaccgctgcaccaacgccgctatggaatatttcaagagtgaagtcatggagatgtgccacagggaggggctttaccaaatcgacctcctaagcggcagcaaggaacggataacggaacgggaatactgggcggcaaagaaagggcagcttgcccttgataaagagaacgccgccagagaagccgcaggacagccgaccaagcccaccaagtttgaaacggacaaggcgaagctgcgccggacgatacggcaggcactttcccaagccgccagctttgacgagttttcttctcttttgctgcgggagggcgtgaccgtcaaggagagccgggggcgtctttcctacctcacgccagacaggacaaagcctatcacagcccggaagctgggggacgattttgacaaggctgctgtccttgccctgctcacgcagaacgcccacagagccgccgaacagaccacagccatacccgaatacccccacacccaaaagggacgcttgcgggaggaaaaagccaaaaaaaccaccccggcagacaacaccttgcagcgcatggttgaccgggaagccaagcgagccgagggcaagggtgtgggctatgaccgctgggcggcaaagcacaacctaaagcaaatggcagctaccgttaccgcctatcagcagtacggcttttcttccccggaggaactggacaaagtctgttctgccgcttataccaccatgcaggaaagccttgcagagctgaagcaggtggaaaagacgctgaacggaaaaagggagctgcaacggcaagtgcttgcctattccaagacccgccctgtccgggacgggctgaaacagcagaaaaacgccaaagcaaaagcagcctaccgtcagaagcacgaaagcgactttatcatagcagacgcagccgcccgctatttcagggagaacggcatttccaagctgccgagctataaagccctgcaagcagagattgaaagccttatcaaagagaaaaacagcggctacaacgattaccgggcaaaacgggaggaataccgccgcttacagactgtcaagggcaatatcgaccagattttacgccgggaacgcaagcctgtgaaaaggcaggaacaggagcgataaaaaaccgcccccaaatgtacctgaacccatacagaacaagggggctgccccgtaccctatccgcaataccaaaggattttttaacgggcttacagggcagaaaaaccccgaaaatgataccgagatgatacagaattatcgccgataccgccacaccagcggaaacggcagaaaggagcgcacccatgccaagaatgagcaagaaacggcggctggaatggtcttttttcctgcggcaagtaaaagtcgggaataccacctgcgaccgtatcacatacaacgacctctgccggggctgtacccatagctgcaagcagagcttccgggcgattatcgtcctctgcccccggtatttctctaagagatggaaacacagggaggacaccgccaatggcagataaccgcaaatattactacctcaaactgaaagaaaacttctttgacagcgactccattgtgctgctggaagatatgaaagacgggattttatattccaatatcctcttgaagctgtacttaaaatcgctgaaaaacggcgggaaattgcagcttgacgagcatatcccctacacagcgcagatgatagcgacactgacccgccaccagatagggacggttgagagggctttagagattttccggcagttggggcttgtggagcaacttgacagcggggctttctatatgaccgacattgagctgatgataggacagtcctctaccgaagccgagcgaaaacgggctgcaaggctggaaaacaaggcacttttaccgccccggacaaaaggcggacatttgtccgacattcgtccaccagagatagagttagagaaagagatagagatagaaaaagagagagagggagaaacgggacaccccgtccccgccgcttatggcagatacaacaatgtgatactgaccgatacagagctttccgggctgaaaacagagctgcccgacaagtgggagtattatattgaccggctttcctgccatatcgcttccaccggaaagcagtaccatagccatgcagccaccatttacaagtgggcgcaggaggacgctgccaaaggcaaggctgccccgaaacagggcatacccgattattcatgcaaggagggcgagagcttatgaaaaacgagattgaagctatgattacggacattacagccactaccgccgaagcggaggactacacaggcgaggacgggcttttatactgcggcaagtgccatacgcccaaagaagcctacttttcaaaagaaaccgcccaatggttagggtatgaccgccacccaacagactgcgactgccagcgagcagcccgtgaaaagcagcaagccgccgaaagccgacagaagcaccttgaaaaagtggaggacttgaaacgccggggctttactgaccctgctatgcggaactggacatttgagcatgacaacggcagaaacccacagaccgaaactgcccgcttttatgtggagagctgggaaaccatgcaggctgaaaatatcggctacctgttttggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggactggaacaggtttacagcgtgattgacagccgttaccgaagcggcaagccgctgatcgccacgaccaacctcacactggaggaattgcagcacccgcaggacacgccccacgcccgtatctatgacaggctgacttccatgtgcgcccccgtccgcttcacgggcagcaacttccgaaaggaaaccgcacaggaaaagctggaacgattaaagcaactgatgaagcagcgaaaggagagcctatgacagaaaccaaacagacaagcaccaccaaaacagaacgccgcccggactgtgtgacagaaatccgcatgggcaactccgtccttaccgtttccggcttcttcaagcagggtgcaaccgacaccgcagccgacaagatgatgaaagtgctggaagcggaagctgctgccggacatacgccaccgttcagcgcataagtgatgacatggaaaagcggtcatgccggggagcatgaccgctggaatatcagtaacaactttattttttccgaagtttcaactcaatgccttttggaacagctatatcccgcaacagttttgcgataacagaagcctgttctttcttccccatactttgaaaatccttatcggatttaactgtttgcaagatattttcaatttctttaatcgttaagagattgactgcaacacagaatagattttttctgcgcccgtcattatagtgtgacaagaggaaatccaataatttgcgcttttcttcctgttcagcattataggcgggaatccctatctggctggctttttccatgtcattcatttgattatgatgagttataaaggaatcaaaatcatctatatgagcgtatttgtcacaagggaagctggtacactgaaagcaatattcgattttcccatgttcaatactacactttgcgattttacaactttgattatcaacgccgcaaccggaacaatgccctgccaaattcataggacataatttacaatttagaccacaaagagaaaggtactgattgttacggacaaaccctttcattgtcacacccccccttgtattgattagctccattttaccataagaacaagagtttttctactatgcaatcccaatcatctgctacacaaaaaacggcgatttgaccgaccataaagaagcagatttgacgcttttgccgctatacagacagccaccccatgtggtacaatcaaggtacggaatagtggggctggctgtcggaaacggaggattttatgttaagacagaccaaccaacaaccaattaccgccctttacccaagactttcccatgaggacgagctgcaaggcgagagcaattccatttccaaccagaagcgtatccttgaaacctatgcaaagcagaacggcttttccaatctgcgctggtacacggacgacggttattctggtgcgaactttcaaagacccggttttcaagccatgcttgcggacattgaagccggaaaagtcgggacagttatcgtaaaggatatgtcgaggttagggcgaaactacctgcaagtgggaatgtacacggaaatgattttcccacagaaaggcgtccgcttcatcgctatcaatgacggagtggacagcgcacagggcgacaatgactttgccccgctgcggaatatctttaacgaatggctggtgagagatacgagcaagaaaatcaaagcagtagcgaaaccagcaaaggaaacgaagctggatcgtctttgatttaagattgaaagctcgcgagagtttttaataccaatatcaaagagtttgatcctggctcaggacgaacgctggcggcgcgcctaacacatgcaagtcgaacggagcttacattttgaagttttcggatggacgaatgtaagcttagtggcggacgggtgagtaacacgtgagcaacctgcctttcagagggggataacagccggaaacggctgctaataccgcataatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagccgcggtaatacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcacttaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccgcaaggggggcgctgtcgaaggtgggattgatgactggggtgaagtcgtaacaaggtagccgtatcggaaggtgcggctggatcacctcctttctaaggagcgaagccggcagagagccggcggactctggtcagacagggacaggaaagctcgttgttcatttttgaaggcggacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaccaacaaagccggaaggctttgggaacgcaccttgaaaattgaacaatgaaacaaatctgcaacaaagttttatgtaatgcaaatatcatgaaacaagggtataagcactgcaataaagccgaaagagaaccaagattcaagcatggtcaagctacaaagggcacagggtgaatgccttggcactgggagccgacgaaagacgtgataagctgcgaaaagccacggggagctgcaaataagctttgatccgtggatgtctgaatggagcaatccggcggatgtaacgatccgtcatggcatactgaatccataggtatgtcaggggaaccgcctgaactgaaacatctaagtagggcgaggaagagaaatcaaccgagattccgtaagtagtggcgagcgaaagcggaagaggccaaaccgcatgcagcaatgtgtgcggggttgcggactgcataaggtacgttgaagtctagctgaactgtatgggaaggcagaccaaagagcgtgagagtcgcgtaagcgaaagacagagacggccggcaggatccagagtaccgcgggacacgtgaaaccccgtgggaagccggggggaccaccctccaagcctaaatactccccagtgaccgatagagaatagtactgtgaaggaaaggtgaaaagcaccccgggaggggagtgaaagagcacctgaaaccctgcgcctacaagcacatagagcacgtcaaagtgtgatatggtaccttttgtagaatggtccggcgagcgtatgtatgcagcaaggttaagcgcttaaggcgcggagccgaagggaaaccgagtctgaatagggcgtgaagttgcatgcatagggcccgaaaccgggtgacctatccatgtccaggttgaagtgggagtaaaatcccatggaggaccgaaccgacctccgttgaaaaggcggcggatgaggtgtggatagcggagaaattccaatcgaacccggagatagctggttctccccgaaatagctttagggctagcgttgtattagattaccggaggtaaagcactgaatgggctaggggccgagaggttactgaaccctatcaaactctgaatgccggataattgatgtacagcagtcagactacgtgagataagtctcgtggtcgagagggaaaaagcccagacccacagctaaggtcccaaatacacgttaagtggaaaaggatgtggagttgcacagacaaccaggatgttggcttagaagcagccactcattaaaagagtgcgtaatagctcactggtcgagtgactctgcgccgaaaattcaacggggctaaacgtgtaaccgaagcttgggatttcattcactgaacaatgctttttgtcaggcaggagggaaagatttgctggcgaaggcagctaaattcccaaaagcaaacgagagggaaagcgttggtcagtgaatgaaatggtaggggagcgtcgtatacggggtgaagtatgagcgaaagcgcatgtggactgtatacgagtgagaatgccggaatgagtagcgagaaatatgtgagaatcatattggccgaaagtctaaggtttccggaggaaggttcgtccgctccgggtaagccgggagctaaggtgaggccgaaaggcgtagccgatgcacatacggtagagattccgtagctgccggaggatttaagcagagggacactgtcaaagggtatgacccgggcgttggtagccccgggcgaaagggactgaaatatagtagggaagcatacttggcggcaggcgagaaaagctctgtggatatctgaggcacccgtaccgcaaaccgacacaggtagacaggaagagaattctaaggccaacgggagaagggttgttaaggaactcggcaagttgaccccgtaacttagggaaaaggggtgctcctgaaagggagccgcagagaataggtccaggcgactgtttagcaaaaacacagctctatgctaaatcgaaagatgacgtatatggggtgacacctgcccggtgccggaaggttaagaggaggagtgagagctctgaattgaagccccggtaaacggcggccgtaactataacggtcctaaggtagcgaaattccttgtcaggtaagttctgacccgcacgaatggtgtaacgatctggacactgtctcaacagcccgcccggcgaaattgtagtaccggtgaagatgccggttacccgcgacaagacggaaagaccccatggagctttactgcagcttaatattggatttcggtatttcatgtacaggataggtgggaggcagagaaggcagcacgccagtgttgctggagccgacgttgggataccactcttgaggtgctgaaattctaacctgcggccgtgaatccggtcgggggacagtgttaggcgggcagtttgactggggcggtcgcctccaaaaaggtaacggaggcgctcaaaggttggctcagcatggacggaaaccatgccagagagtgtaaacgcacaagccagcctaactgcgagagcgacagttcgagcagtaacgaaagttggagttagtgatccggtggtatgtgagtggaaatgccatcgctcaacggataaaagctaccctggggataacaggctgatctcccccaagagtccacatcgtcggggaggtttggcacctcgatgtcggctcatcgcatcctggggctgaattcggtcccaagggtttggctgttcgccaattaaagcggtacgcgagctgggttcagaacgtcgtgagacagttcggtccctatctgtcgtgggcgcaggatatttgagaggagctgtccctagtacgagaggaccgggatggacgtacctctggtgcaccagttgtcgtgccaacggcacagctgggcagctaagtacggatcggataaacgctgaaggcatctaagcgtgaagccgacctcaagataagatatgccactgagaaatcaggtaagaccccttgaagactacaaggttgataggccgcatgtggaagcgtcgtgaggcgtgcagcaaggcggtactaatcggtcgagggcttgaccaggcgaagattggttggcagaggcgtttcattgttcgattttgagggtgcgtgaaaagacatgcgccattagctcagttggtagagcagctgactcttaatcagcgggtcccgggttcgagtccctgatggcgcaccagaagatgctgtgccttggggcactcgcgatagaggttccggccgggagaggttggaaagggcgtgctggaggaagggaaaccttttggcagggcgcaggagacggcccgttggtcaagcggttaagacaccggcctctcacgccggtaacgcgggttcgattcccgcacgggtcaccagaggtcatgaccgccggatggcggaggatgatatacagagccttgcggcaggcgatacgggagagtagggtaagaacccggcgccttaccatatcactatggcaggtttccgagaactcccctccgaaccggacttacacctctcgatgtatccggctctccagatgtcagtctaactttcctgcgtgtaacttatcgtgacagtcaatgcagagtgccattgtcttgcgcttacgcccaatcatggcgatttcccattgttttctgccacttaaatctttgagttttcgtatatggtgtatttcaagcggcacattctctgcgccacaccactcacacctgtttgcttgcagtctttttataaggctattacgcccataattctcaaaaattcttgctactatatcaggatttccgctttctactttagtgtcccggcggaacccattattgtaaaacaatacctttccgaccttgccgtttttcttcggatattccacaacaaaatcttttccttgacggtacttgtggataattctgctgattcgtgtccgatattttccagcaaaggttttgagcatactgtatctcattacatagtagaagttattgagtacagacacgttgtttgcaagtcggtagtagttatacaatccacggatttctgcgttgtattggtttaggatttccaaatcgtccaagtgcaacaggcgagtgcgccggacaggctcccaaacctctttgtttccattttgtttgtcgtatttaatcttgagggcattgtaggagaacaatcgttttacccacttatcatggggaacataaagtaagacttttccattgtttacccgtctggtagccccggttttggtctttttgttgtgttcgcttttagcgattgtgacctcatatcccaagaacttcgcagcgtcgtgtccatgagtaatcaatgtcttttcctcggacatttccagatggagtttgtcccggataaagtagcctacatcttgtttaatctgttctgcgtcctctttgctgccgataactccgattaagaaatcatcggcgtatcggatatagcaaagccgtttatagctatcgtccatctggtcgctatatggtatagatttcagactacgccgaagttcccggatttctgcaattaagccctctttttcttccacgctcattttagagatatttcttttaagcctttgttcttttcctcggcagacatccaatttcttcttgaacgcaggattgattttacggcggtttccgcatttgaatttctctgcatactctgccatataactgtccagttcgttcatgtagatgtttgccaggatagggctgatgatggagccttgcggagttccggaataagtattgtggtaattccaatcctccatatatccagctttcaagaacttccagagcagaccgatgaaatattcatctgcaatccgctttcgcaaaatagcaatcaacacatgatggtctacgttgtcaaaacagccctttatatccccctcaacgaaccactttgtccccgtaaaatatttctgcacatatttgagtgccgtatgacagcttctgtttatacggaaaccgtgggaatagtcgctaaaggttggctcataaatactctccaagatgagccgcaccacctcctgtatcagtttatcgtcgaatgacggtatccccagaggacgcattttcccattggatttcgggatatacgttctccttgccgggttaggctgataactaaaatcccgcatcttttcaatgagggcgtttatccttgccattcccattccgtcaatggttttgccgtctgttccggctgtcatgttgcctggtttcgcctgtatccgctgatatgccagcagatagaattgtggattgtacaggttgcggtataaccgctcgtacttgtaactcttgttacacgccttggattttaggctttccaacacattttcaggacttctcataatgcctcacgcacctttcctttttatgaattggttgacatcctgcctcccttcgccatgtagacggctttcccgccctcggactattacggaggctccgttgccatgccggatattcagcgtcatctttcttgggtttttaccccttgaaatttatcgccttgcggcattacgcatagccggatagttccggcgttccggtttaggcaatctccagttagacactttgggataagcgtattgtgatgtcggtagtgggttttcgtccttttccgcttactgcggctggctgtcataagtatcgtgcggtctgtgtttacctgtcacattccgctatgacatacggcgaatacaaccatcctgcgccgccgggtcgagtatcccgcctcggactacccttaaagcagtttagccttgctcctcattcacaatgttgcgtcttgccgctcagtcgtgggtagatggttttcccaactcgcgatttttccgatacgctattgtcccccttgtggtttccctccggggtaaatcggatgacgctaaagtgacgcgtttcacgtctttgatacttttctttaccggcttgctaaagccggattcccaaaatgtccgcgcaccgcctttggatgaaaagcggcgcttctggacgcgcggtctggatgctcatagaatgctccgtttccagctcgatacagccgccgcgaaatcaccctgaattttcccagcggcgccgtattttgccgccggtaagctacgctttcaagtctgtcaaacctgtgtatatgtacaacctggtattttgtatcctttcaaggggaggggttctgttgacaagcggcgcgcactgctgtataatgatgccaatctgaaaggatgtgcgaaatggcactgtttggaaaattttgcattgaacgctgctccggacatatgaaatcgatgaagcattgtacggagcggatttttttcatcggcgcattgaggacggcgccgcctgacggcggcgtctgtttgctgacgccgtgaatggataatcattagccgcggatgatgtttcgtccgcggccctttttatttcctcatacaatcggtattcggtatgtgcaaaaggaggggctgtatccgcagcccctcctttatgcttcctttgaatgccctgcgaaaaattcacggcgtttctatttcttaatcctgcacccttctccattggtgcatatcaaggttggtgtaagctatgaatcatacccttttatcaggcgatgtgccgcgttgccttctgcgttttgcggcgccgctgttgtttgcaaattttttacaatcattttacagcattgctgatatggcgatagtcggccaacttgtcgggagcacgggactagcggcggtcagcagcgcatccatgcttgtttttattatcaattcaatctgtaccggcgttaccatgggcggtgcggtacttgtcgcacagtacaagggcgcggacgatgctgtttcccaagcagaagtcactcatacgctgttcgtactttcagcactgtcagccgttcttgtaaccattgcaggactgctggcataccggccgatcctgactctgatggatgtacccagagccgccatgccgcacgcccttgcgtatatgcaggtgatctgtttgggaaccatatttgtatttggatacaatgcggcttgttcgatcctgcgaggcttgggaggctccattggaccgcttttgtttgtagcgatcgccgcagccgtcaatattgcgcttgattttctgttcgtcggcggatttcagatgggtacgcgcggcgcggcggcggcgacagtcctttcacaaggcgtatccttttctattgcgcttgtgtttcttcgccaacgttatactgtatttcattttattaataatccgtttttaataaaatatggatatataaaatctattttaaaaattggcattccatcagctatacagatgagcgtgctaaatctgtcctacctaattgtcactggcatgctcaacggctatggcgttgccatttcggcggcggccggaatcggtctgaaaatcaacacatttgcagccatgccatgctgggcgatcggtcaggccgtcaccacgatggctggtcagtgcattggtgcacagatgccgcagcgcgctgaacaaactgccaaaacaggactgttctgcgctgttgcgtcaggaatcatcatgacacttgcgattcaactgtttgccggaccagctatttctctattcattccgatacatgcagacccagcggttttacaagcagggatactttatctgcgcatctgctgctcaatcaattttttagcctacgctgtcatgtatatatttgactcctttgcaactggcgttggcgatgcatttttcgccatgttcaatgcacttttgcattccatcaccatgcgcttgcttctcagttggctgctcgccgtaaaatgtgggctgggctatatcgggatttgtctcggtgaagcgattgcgccgattatacctgcgatcgttggcgtgtgctactttctgcgcggttcttggcgcagcaatgataacgccgcaagaaattataagaaagattccgattgatcaatttccattattatccgaccacaaaagcgcgcaaaggaccgccggcccaatcgggccggcggtcctgtcctgatcattcgcggggattatccccgcgcggatgcagattcttatttggagcgcttctttcattcgcggggattatccccgcgcggatgcagattcttatttggagcgcttcttcgcagccagagcgccgacgccggccagaccagcgaacgcagccgcaacggcagcgttgatcatgtcgctggcgcccgtggacgggttgcccttgttctcgtccggagtgctcgttgtatcatcggaatccgtcacgtcgtccttggagacaaccgtgccgtcctcgatgaacttgttcgtaacaaagaagttgtcgagcttgttcgtacggaagttcagcgtgttttcctcgccgtcaaaggtcgcgttgatgcggtagatggtgccgttcgcatagcgataggtgtacatcttctcgaaatcgtcgacgatatcgtcaacatcgagtgccatacggccggtcgctgcgaaggacggcttgccagggaaggagaagaacttgaagtcctgatccggatacttggcaagaatctctttgatgcccgcattgttgtggaccatgttcttggtgctctcgtcagtcacgttgaccgtgaattcccagccgttgccggacagggtgacgtttttgtaatcgttgatctccgcgatcttgtcgaactgcgtgtcagtgatgaccggacggtcgttgtcgatctcaacgacgtcgcccttgtcgagaccgctgatgtaatcgccgttcgcttcctcgtagccgtactggaacttgacttcctgcgtgaacacggacaggttgttcgatttgcgcaccagcttgacgttgtacttcacgtcaaccggcttggtcacgacagtgtcgcgcgcctcaacgtacaggtagtactggcccttgtactcctcgatctcaaagcggctcatgcccttggaggagatcttggaatagttgaacttgtagccgtccatcagttcctcagtgatcttggtgtccttgccgtcaaccgtcaggctgaccgggaacttgtactctttgccaggctcgagaacatcgtcgccgagcacaacgccgtcctcgtcagcgccgatcttcacatcggtcgcgttctcgagggaaacggactcgtcttcggaagaagaatcgctcgaggagctgttgtcctccgcgtcgctcgaggagctgcccggatcaccggaatcgagaagcaggtcggcatagctggaaacaacggcggtaccgttgccgatttcgtcattcgcaaaagctgtcacgccaacggacatggtcgtggcggcggcaagcataactgcaagcatttttttcatattggggttcctcctgaaaaatcgtttcgccctccggcccggcgcatccgagccgcttggaacgagacttagtatatctgcaaaacaagcttttttcaagaggtttttgttaccaaattgtcataattattattaaaatttaataaaacaaatcaacaaataatcaaaacttttatctaaaaaatcaaaaatccatgatatggccgacatgtctggatgctcatagaatgctccgtttccagctcgatacagccgccgcgaaatc
